United States Patent 12,553,037 (ENGINEERED CLASS 2, TYPE V REPRESSOR SYSTEMS) - sequence listing, part 6

SEQ ID NO: 55019 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcaccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55020 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcaccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55021 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55022 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacaccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55023 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcaccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55024 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55025 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55026 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55027 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55028 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55029 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55030 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55031 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55032 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55033 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55034 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55035 - RNA, 289 nt, synthetic construct
  source 1..289: mol_type = other RNA
cgctcttccgcgtctcttaagctagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55036 - RNA, 289 nt, synthetic construct
  source 1..289: mol_type = other RNA
cgctcttccgcgtctcttaagcttgtagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55037 - RNA, 289 nt, synthetic construct
  source 1..289: mol_type = other RNA
cgctcttccgcgtctcttaagcttgcgctagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55038 - RNA, 289 nt, synthetic construct
  source 1..289: mol_type = other RNA
cgctcttccgcgtctcttaagcttgcgcggctagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55039 - RNA, 289 nt, synthetic construct
  source 1..289: mol_type = other RNA
cgctcttccgcgtctcttaagcttgcgcggcagctagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55040 - RNA, 289 nt, synthetic construct
  source 1..289: mol_type = other RNA
cgctcttccgcgtctcttaagcttgcgcggcagccattagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55041 - RNA, 289 nt, synthetic construct
  source 1..289: mol_type = other RNA
cgctcttccgcgtctcttaagcttgcgcggcagccatatgtagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55042 - RNA, 289 nt, synthetic construct
  source 1..289: mol_type = other RNA
cgctcttccgcgtctcttaagcttgcgcggcagccatatgggctagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55043 - RNA, 289 nt, synthetic construct
  source 1..289: mol_type = other RNA
cgctcttccgcgtctcttaagcttgcgcggcagccatatgggcccttaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55044 - RNA, 289 nt, synthetic construct
  source 1..289: mol_type = other RNA
cgctcttccgcgtctcttaagcttgcgcggcagccatatgggccctatgtagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55045 - RNA, 289 nt, synthetic construct
  source 1..289: mol_type = other RNA
cgctcttccgcgtctcttaagcttgcgcggcagccatatgggccctatggagtagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55046 - RNA, 289 nt, synthetic construct
  source 1..289: mol_type = other RNA
cgctcttccgcgtctcttaagcttgcgcggcagccatatgggccctatggagatatagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55047 - RNA, 289 nt, synthetic construct
  source 1..289: mol_type = other RNA
cgctcttccgcgtctcttaagcttgcgcggcagccatatgggccctatggagatatactagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55048 - RNA, 289 nt, synthetic construct
  source 1..289: mol_type = other RNA
cgctcttccgcgtctcttaagcttgcgcggcagccatatgggccctatggagatatacaagtaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55049 - RNA, 289 nt, synthetic construct
  source 1..289: mol_type = other RNA
cgctcttccgcgtctcttaagcttgcgcggcagccatatgggccctatggagatatacaagacatagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55050 - RNA, 289 nt, synthetic construct
  source 1..289: mol_type = other RNA
cgctcttccgcgtctcttaagcttgcgcggcagccatatgggccctatggagatatacaagacagtgtaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55051 - RNA, 289 nt, synthetic construct
  source 1..289: mol_type = other RNA
cgctcttccgcgtctcttaagcttgcgcggcagccatatgggccctatggagatatacaagacagtgtcttagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55052 - RNA, 289 nt, synthetic construct
  source 1..289: mol_type = other RNA
cgctcttccgcgtctcttaagcttgcgcggcagccatatgggccctatggagatatacaagacagtgtctgcatagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55053 - RNA, 289 nt, synthetic construct
  source 1..289: mol_type = other RNA
cgctcttccgcgtctcttaagcttgcgcggcagccatatgggccctatggagatatacaagacagtgtctgcatggtagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55054 - RNA, 289 nt, synthetic construct
  source 1..289: mol_type = other RNA
cgctcttccgcgtctcttaagcttgcgcggcagccatatgggccctatggagatatacaagacagtgtctgcatggaagtagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55055 - RNA, 289 nt, synthetic construct
  source 1..289: mol_type = other RNA
cgctcttccgcgtctcttaagcttgcgcggcagccatatgggccctatggagatatacaagacagtgtctgcatggaagagatagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55056 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55057 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccatagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55058 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55059 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55060 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55061 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55062 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55063 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55064 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55065 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55066 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55067 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55068 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55069 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55070 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55071 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55072 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55073 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55074 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55075 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55076 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55077 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55078 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55079 - RNA, 289 nt, synthetic construct
  source 1..289: mol_type = other RNA
cgctcttccgcgtctcttaagctaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55080 - RNA, 289 nt, synthetic construct
  source 1..289: mol_type = other RNA
cgctcttccgcgtctcttaagcttgtacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55081 - RNA, 289 nt, synthetic construct
  source 1..289: mol_type = other RNA
cgctcttccgcgtctcttaagcttgcgctacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55082 - RNA, 289 nt, synthetic construct
  source 1..289: mol_type = other RNA
cgctcttccgcgtctcttaagcttgcgcggctaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55083 - RNA, 289 nt, synthetic construct
  source 1..289: mol_type = other RNA
cgctcttccgcgtctcttaagcttgcgcggcagctacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55084 - RNA, 289 nt, synthetic construct
  source 1..289: mol_type = other RNA
cgctcttccgcgtctcttaagcttgcgcggcagccattacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55085 - RNA, 289 nt, synthetic construct
  source 1..289: mol_type = other RNA
cgctcttccgcgtctcttaagcttgcgcggcagccatatgtaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55086 - RNA, 289 nt, synthetic construct
  source 1..289: mol_type = other RNA
cgctcttccgcgtctcttaagcttgcgcggcagccatatgggctacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55087 - RNA, 289 nt, synthetic construct
  source 1..289: mol_type = other RNA
cgctcttccgcgtctcttaagcttgcgcggcagccatatgggcccttacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55088 - RNA, 289 nt, synthetic construct
  source 1..289: mol_type = other RNA
cgctcttccgcgtctcttaagcttgcgcggcagccatatgggccctatgtacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55089 - RNA, 289 nt, synthetic construct
  source 1..289: mol_type = other RNA
cgctcttccgcgtctcttaagcttgcgcggcagccatatgggccctatggagtactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55090 - RNA, 289 nt, synthetic construct; identical to SEQ ID NO: 54695
  source 1..289: mol_type = other RNA

SEQ ID NO: 55091 - RNA, 289 nt, synthetic construct
  source 1..289: mol_type = other RNA
cgctcttccgcgtctcttaagcttgcgcggcagccatatgggccctatggagatatactacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55092 - RNA, 289 nt, synthetic construct
  source 1..289: mol_type = other RNA
cgctcttccgcgtctcttaagcttgcgcggcagccatatgggccctatggagatatacaagtacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55093 - RNA, 289 nt, synthetic construct
  source 1..289: mol_type = other RNA
cgctcttccgcgtctcttaagcttgcgcggcagccatatgggccctatggagatatacaagacatactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55094 - RNA, 289 nt, synthetic construct
  source 1..289: mol_type = other RNA
cgctcttccgcgtctcttaagcttgcgcggcagccatatgggccctatggagatatacaagacagtgtacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55095 - RNA, 289 nt, synthetic construct
  source 1..289: mol_type = other RNA
cgctcttccgcgtctcttaagcttgcgcggcagccatatgggccctatggagatatacaagacagtgtcttactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55096 - RNA, 289 nt, synthetic construct
  source 1..289: mol_type = other RNA
cgctcttccgcgtctcttaagcttgcgcggcagccatatgggccctatggagatatacaagacagtgtctgcatacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55097 - RNA, 289 nt, synthetic construct
  source 1..289: mol_type = other RNA
cgctcttccgcgtctcttaagcttgcgcggcagccatatgggccctatggagatatacaagacagtgtctgcatggtacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55098 - RNA, 289 nt, synthetic construct
  source 1..289: mol_type = other RNA
cgctcttccgcgtctcttaagcttgcgcggcagccatatgggccctatggagatatacaagacagtgtctgcatggaagtaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55099 - RNA, 289 nt, synthetic construct
  source 1..289: mol_type = other RNA
cgctcttccgcgtctcttaagcttgcgcggcagccatatgggccctatggagatatacaagacagtgtctgcatggaagagatacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55100 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55101 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccataccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55102 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55103 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55104 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55105 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55106 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55107 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55108 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55109 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55110 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55111 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55112 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55113 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55114 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55115 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55116 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55117 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55118 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55119 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55120 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55121 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55122 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55123 - RNA, 289 nt, synthetic construct; identical to SEQ ID NO: 54695
  source 1..289: mol_type = other RNA

SEQ ID NO: 55124 - RNA, 289 nt, synthetic construct
  source 1..289: mol_type = other RNA
cgctcttccgcgtctcttaagcttgttgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55125 - RNA, 289 nt, synthetic construct
  source 1..289: mol_type = other RNA
cgctcttccgcgtctcttaagcttgcgcttgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55126 - RNA, 289 nt, synthetic construct
  source 1..289: mol_type = other RNA
cgctcttccgcgtctcttaagcttgcgcggcttgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55127 - RNA, 289 nt, synthetic construct
  source 1..289: mol_type = other RNA
cgctcttccgcgtctcttaagcttgcgcggcagcttgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55128 - RNA, 289 nt, synthetic construct
  source 1..289: mol_type = other RNA
cgctcttccgcgtctcttaagcttgcgcggcagccatttgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55129 - RNA, 289 nt, synthetic construct
  source 1..289: mol_type = other RNA
cgctcttccgcgtctcttaagcttgcgcggcagccatatgttgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55130 - RNA, 289 nt, synthetic construct
  source 1..289: mol_type = other RNA
cgctcttccgcgtctcttaagcttgcgcggcagccatatgggcttgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55131 - RNA, 289 nt, synthetic construct
  source 1..289: mol_type = other RNA
cgctcttccgcgtctcttaagcttgcgcggcagccatatgggccctttggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55132 - RNA, 289 nt, synthetic construct
  source 1..289: mol_type = other RNA
cgctcttccgcgtctcttaagcttgcgcggcagccatatgggccctatgttgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55133 - RNA, 289 nt, synthetic construct
  source 1..289: mol_type = other RNA
cgctcttccgcgtctcttaagcttgcgcggcagccatatgggccctatggagttgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55134 - RNA, 289 nt, synthetic construct
  source 1..289: mol_type = other RNA
cgctcttccgcgtctcttaagcttgcgcggcagccatatgggccctatggagatattgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55135 - RNA, 289 nt, synthetic construct
  source 1..289: mol_type = other RNA
cgctcttccgcgtctcttaagcttgcgcggcagccatatgggccctatggagatatacttgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55136 - RNA, 289 nt, synthetic construct
  source 1..289: mol_type = other RNA
cgctcttccgcgtctcttaagcttgcgcggcagccatatgggccctatggagatatacaagttggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55137 - RNA, 289 nt, synthetic construct
  source 1..289: mol_type = other RNA
cgctcttccgcgtctcttaagcttgcgcggcagccatatgggccctatggagatatacaagacattgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55138 - RNA, 289 nt, synthetic construct
  source 1..289: mol_type = other RNA
cgctcttccgcgtctcttaagcttgcgcggcagccatatgggccctatggagatatacaagacagtgttggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55139 - RNA, 289 nt, synthetic construct
  source 1..289: mol_type = other RNA
cgctcttccgcgtctcttaagcttgcgcggcagccatatgggccctatggagatatacaagacagtgtctttgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55140 - RNA, 289 nt, synthetic construct
  source 1..289: mol_type = other RNA
cgctcttccgcgtctcttaagcttgcgcggcagccatatgggccctatggagatatacaagacagtgtctgcattgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55141 - RNA, 289 nt, synthetic construct
  source 1..289: mol_type = other RNA
cgctcttccgcgtctcttaagcttgcgcggcagccatatgggccctatggagatatacaagacagtgtctgcatggttgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55142 - RNA, 289 nt, synthetic construct
  source 1..289: mol_type = other RNA
cgctcttccgcgtctcttaagcttgcgcggcagccatatgggccctatggagatatacaagacagtgtctgcatggaagttgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55143 - RNA, 289 nt, synthetic construct
  source 1..289: mol_type = other RNA
cgctcttccgcgtctcttaagcttgcgcggcagccatatgggccctatggagatatacaagacagtgtctgcatggaagagattgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55144 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagttggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55145 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccattgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55146 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgttggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55147 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggttgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55148 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtattgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55149 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgttgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55150 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcttgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55151 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55152 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcttgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55153 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagattgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55154 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacttggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55155 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcttgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55156 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacttggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55157 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagttgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55158 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtattgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55159 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactattgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55160 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagttgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55161 - RNA, 289 nt, synthetic construct; identical to SEQ ID NO: 54695
  source 1..289: mol_type = other RNA

SEQ ID NO: 55162 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgttgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55163 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55164 - RNA, 289 nt, synthetic construct; identical to SEQ ID NO: 54695
  source 1..289: mol_type = other RNA

SEQ ID NO: 55165 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgttgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55166 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaattgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55167 - RNA, 289 nt, synthetic construct
  source 1..289: mol_type = other RNA
cgctcttccgcgtctcttaagcttccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55168 - RNA, 289 nt, synthetic construct
  source 1..289: mol_type = other RNA
cgctcttccgcgtctcttaagcttgttcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55169 - RNA, 289 nt, synthetic construct
  source 1..289: mol_type = other RNA
cgctcttccgcgtctcttaagcttgcgcttcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55170 - RNA, 289 nt, synthetic construct
  source 1..289: mol_type = other RNA
cgctcttccgcgtctcttaagcttgcgcggcttccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55171 - RNA, 289 nt, synthetic construct
  source 1..289: mol_type = other RNA
cgctcttccgcgtctcttaagcttgcgcggcagcttcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55172 - RNA, 289 nt, synthetic construct
  source 1..289: mol_type = other RNA
cgctcttccgcgtctcttaagcttgcgcggcagccatttcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55173 - RNA, 289 nt, synthetic construct
  source 1..289: mol_type = other RNA
cgctcttccgcgtctcttaagcttgcgcggcagccatatgttccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55174 - RNA, 289 nt, synthetic construct
  source 1..289: mol_type = other RNA
cgctcttccgcgtctcttaagcttgcgcggcagccatatgggcttcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55175 - RNA, 289 nt, synthetic construct
  source 1..289: mol_type = other RNA
cgctcttccgcgtctcttaagcttgcgcggcagccatatgggccctttcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55176 - RNA, 289 nt, synthetic construct
  source 1..289: mol_type = other RNA
cgctcttccgcgtctcttaagcttgcgcggcagccatatgggccctatgttcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55177 - RNA, 289 nt, synthetic construct
  source 1..289: mol_type = other RNA
cgctcttccgcgtctcttaagcttgcgcggcagccatatgggccctatggagttctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55178 - RNA, 289 nt, synthetic construct
  source 1..289: mol_type = other RNA
cgctcttccgcgtctcttaagcttgcgcggcagccatatgggccctatggagatattcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55179 - RNA, 289 nt, synthetic construct
  source 1..289: mol_type = other RNA
cgctcttccgcgtctcttaagcttgcgcggcagccatatgggccctatggagatatacttcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55180 - RNA, 289 nt, synthetic construct
  source 1..289: mol_type = other RNA
cgctcttccgcgtctcttaagcttgcgcggcagccatatgggccctatggagatatacaagttcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55181 - RNA, 289 nt, synthetic construct
  source 1..289: mol_type = other RNA
cgctcttccgcgtctcttaagcttgcgcggcagccatatgggccctatggagatatacaagacattctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55182 - RNA, 289 nt, synthetic construct
  source 1..289: mol_type = other RNA
cgctcttccgcgtctcttaagcttgcgcggcagccatatgggccctatggagatatacaagacagtgttcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55183 - RNA, 289 nt, synthetic construct
  source 1..289: mol_type = other RNA
cgctcttccgcgtctcttaagcttgcgcggcagccatatgggccctatggagatatacaagacagtgtctttctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55184 - RNA, 289 nt, synthetic construct
  source 1..289: mol_type = other RNA
cgctcttccgcgtctcttaagcttgcgcggcagccatatgggccctatggagatatacaagacagtgtctgcattcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55185 - RNA, 289 nt, synthetic construct
  source 1..289: mol_type = other RNA
cgctcttccgcgtctcttaagcttgcgcggcagccatatgggccctatggagatatacaagacagtgtctgcatggttcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55186 - RNA, 289 nt, synthetic construct
  source 1..289: mol_type = other RNA
cgctcttccgcgtctcttaagcttgcgcggcagccatatgggccctatggagatatacaagacagtgtctgcatggaagttccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55187 - RNA, 289 nt, synthetic construct
  source 1..289: mol_type = other RNA
cgctcttccgcgtctcttaagcttgcgcggcagccatatgggccctatggagatatacaagacagtgtctgcatggaagagattcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55188 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagttcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55189 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccattccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55190 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgttcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55191 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggttcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55192 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtattcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55193 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgttcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55194 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcttcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55195 - RNA, 289 nt, synthetic construct; identical to SEQ ID NO: 54695
  source 1..289: mol_type = other RNA

SEQ ID NO: 55196 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcttcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55197 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagattcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55198 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacttcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55199 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcttcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55200 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacttcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55201 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagttcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55202 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtattcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55203 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactattcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55204 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagttcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55205 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55206 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgttcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55207 - RNA, 289 nt, synthetic construct; identical to SEQ ID NO: 54695
  source 1..289: mol_type = other RNA

SEQ ID NO: 55208 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55209 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgttcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55210 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaattcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55211 - RNA, 289 nt, synthetic construct
  source 1..289: mol_type = other RNA
cgctcttccgcgtctcttaagctggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55212 - RNA, 289 nt, synthetic construct
  source 1..289: mol_type = other RNA
cgctcttccgcgtctcttaagcttgtggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55213 - RNA, 289 nt, synthetic construct
  source 1..289: mol_type = other RNA
cgctcttccgcgtctcttaagcttgcgctggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55214 - RNA, 289 nt, synthetic construct
  source 1..289: mol_type = other RNA
cgctcttccgcgtctcttaagcttgcgcggctggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55215 - RNA, 289 nt, synthetic construct
  source 1..289: mol_type = other RNA
cgctcttccgcgtctcttaagcttgcgcggcagctggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55216 - RNA, 289 nt, synthetic construct
  source 1..289: mol_type = other RNA
cgctcttccgcgtctcttaagcttgcgcggcagccattggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55217 - RNA, 289 nt, synthetic construct
  source 1..289: mol_type = other RNA
cgctcttccgcgtctcttaagcttgcgcggcagccatatgtggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55218 - RNA, 289 nt, synthetic construct
  source 1..289: mol_type = other RNA
cgctcttccgcgtctcttaagcttgcgcggcagccatatgggctggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55219 - RNA, 289 nt, synthetic construct
  source 1..289: mol_type = other RNA
cgctcttccgcgtctcttaagcttgcgcggcagccatatgggcccttgggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55220 - RNA, 289 nt, synthetic construct
  source 1..289: mol_type = other RNA
cgctcttccgcgtctcttaagcttgcgcggcagccatatgggccctatgtggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55221 - RNA, 289 nt, synthetic construct
  source 1..289: mol_type = other RNA
cgctcttccgcgtctcttaagcttgcgcggcagccatatgggccctatggagtggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55222 - RNA, 289 nt, synthetic construct
  source 1..289: mol_type = other RNA
cgctcttccgcgtctcttaagcttgcgcggcagccatatgggccctatggagatatggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55223 - RNA, 289 nt, synthetic construct
  source 1..289: mol_type = other RNA
cgctcttccgcgtctcttaagcttgcgcggcagccatatgggccctatggagatatactggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55224 - RNA, 289 nt, synthetic construct
  source 1..289: mol_type = other RNA
cgctcttccgcgtctcttaagcttgcgcggcagccatatgggccctatggagatatacaagtgggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55225 - RNA, 289 nt, synthetic construct
  source 1..289: mol_type = other RNA
cgctcttccgcgtctcttaagcttgcgcggcagccatatgggccctatggagatatacaagacatggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55226 - RNA, 289 nt, synthetic construct
  source 1..289: mol_type = other RNA
cgctcttccgcgtctcttaagcttgcgcggcagccatatgggccctatggagatatacaagacagtgtgggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55227 - RNA, 289 nt, synthetic construct
  source 1..289: mol_type = other RNA
cgctcttccgcgtctcttaagcttgcgcggcagccatatgggccctatggagatatacaagacagtgtcttggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55228 - RNA, 289 nt, synthetic construct; identical to SEQ ID NO: 54695
  source 1..289: mol_type = other RNA

SEQ ID NO: 55229 - RNA, 289 nt, synthetic construct
  source 1..289: mol_type = other RNA
cgctcttccgcgtctcttaagcttgcgcggcagccatatgggccctatggagatatacaagacagtgtctgcatggtggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55230 - RNA, 289 nt, synthetic construct
  source 1..289: mol_type = other RNA
cgctcttccgcgtctcttaagcttgcgcggcagccatatgggccctatggagatatacaagacagtgtctgcatggaagtggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55231 - RNA, 289 nt, synthetic construct
  source 1..289: mol_type = other RNA
cgctcttccgcgtctcttaagcttgcgcggcagccatatgggccctatggagatatacaagacagtgtctgcatggaagagatggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55232 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtgggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55233 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccatggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55234 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55235 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55236 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55237 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55238 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55239 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55240 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55241 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55242 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactgggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55243 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55244 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactgggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55245 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55246 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55247 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55248 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55249 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55250 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55251 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55252 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctgggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55253 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55254 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55255 - RNA, 289 nt, synthetic construct
  source 1..289: mol_type = other RNA
cgctcttccgcgtctcttaagctgccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55256 - RNA, 289 nt, synthetic construct
  source 1..289: mol_type = other RNA
cgctcttccgcgtctcttaagcttgtgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55257 - RNA, 289 nt, synthetic construct
  source 1..289: mol_type = other RNA
cgctcttccgcgtctcttaagcttgcgctgcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55258 - RNA, 289 nt, synthetic construct
  source 1..289: mol_type = other RNA
cgctcttccgcgtctcttaagcttgcgcggctgccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55259 - RNA, 289 nt, synthetic construct
  source 1..289: mol_type = other RNA
cgctcttccgcgtctcttaagcttgcgcggcagctgcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55260 - RNA, 289 nt, synthetic construct
  source 1..289: mol_type = other RNA
cgctcttccgcgtctcttaagcttgcgcggcagccattgcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55261 - RNA, 289 nt, synthetic construct
  source 1..289: mol_type = other RNA
cgctcttccgcgtctcttaagcttgcgcggcagccatatgtgccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55262 - RNA, 289 nt, synthetic construct
  source 1..289: mol_type = other RNA
cgctcttccgcgtctcttaagcttgcgcggcagccatatgggctgcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55263 - RNA, 289 nt, synthetic construct
  source 1..289: mol_type = other RNA
cgctcttccgcgtctcttaagcttgcgcggcagccatatgggcccttgcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55264 - RNA, 289 nt, synthetic construct
  source 1..289: mol_type = other RNA
cgctcttccgcgtctcttaagcttgcgcggcagccatatgggccctatgtgcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55265 - RNA, 289 nt, synthetic construct
  source 1..289: mol_type = other RNA
cgctcttccgcgtctcttaagcttgcgcggcagccatatgggccctatggagtgctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55266 - RNA, 289 nt, synthetic construct
  source 1..289: mol_type = other RNA
cgctcttccgcgtctcttaagcttgcgcggcagccatatgggccctatggagatatgcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55267 - RNA, 289 nt, synthetic construct
  source 1..289: mol_type = other RNA
cgctcttccgcgtctcttaagcttgcgcggcagccatatgggccctatggagatatactgcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55268 - RNA, 289 nt, synthetic construct
  source 1..289: mol_type = other RNA
cgctcttccgcgtctcttaagcttgcgcggcagccatatgggccctatggagatatacaagtgcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55269 - RNA, 289 nt, synthetic construct
  source 1..289: mol_type = other RNA
cgctcttccgcgtctcttaagcttgcgcggcagccatatgggccctatggagatatacaagacatgctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55270 - RNA, 289 nt, synthetic construct
  source 1..289: mol_type = other RNA
cgctcttccgcgtctcttaagcttgcgcggcagccatatgggccctatggagatatacaagacagtgtgcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55271 - RNA, 289 nt, synthetic construct
  source 1..289: mol_type = other RNA
cgctcttccgcgtctcttaagcttgcgcggcagccatatgggccctatggagatatacaagacagtgtcttgctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55272 - RNA, 289 nt, synthetic construct
  source 1..289: mol_type = other RNA
cgctcttccgcgtctcttaagcttgcgcggcagccatatgggccctatggagatatacaagacagtgtctgcatgcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55273 - RNA, 289 nt, synthetic construct
  source 1..289: mol_type = other RNA
cgctcttccgcgtctcttaagcttgcgcggcagccatatgggccctatggagatatacaagacagtgtctgcatggtgcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55274 - RNA, 289 nt, synthetic construct
  source 1..289: mol_type = other RNA
cgctcttccgcgtctcttaagcttgcgcggcagccatatgggccctatggagatatacaagacagtgtctgcatggaagtgccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55275 - RNA, 289 nt, synthetic construct
  source 1..289: mol_type = other RNA
cgctcttccgcgtctcttaagcttgcgcggcagccatatgggccctatggagatatacaagacagtgtctgcatggaagagatgcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55276 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtgcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55277 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccatgccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55278 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtgcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55279 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtgcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55280 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatgcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55281 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtgcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55282 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctgcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55283 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctgcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55284 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctgcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55285 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatgcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55286 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactgcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55287 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctgcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55288 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactgcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55289 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtgcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55290 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatgcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55291 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatgcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55292 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtgcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55293 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttgcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55294 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtgcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55295 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctgcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55296 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctgcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55297 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtgcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55298 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatgcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55299 - RNA, 289 nt, synthetic construct
  source 1..289: mol_type = other RNA
cgctcttccgcgtctcttaagctcgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55300 - RNA, 289 nt, synthetic construct
  source 1..289: mol_type = other RNA
cgctcttccgcgtctcttaagcttgtcgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55301 - RNA, 289 nt, synthetic construct
  source 1..289: mol_type = other RNA
cgctcttccgcgtctcttaagcttgcgctcgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55302 - RNA, 289 nt, synthetic construct
  source 1..289: mol_type = other RNA
cgctcttccgcgtctcttaagcttgcgcggctcgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55303 - RNA, 289 nt, synthetic construct
  source 1..289: mol_type = other RNA
cgctcttccgcgtctcttaagcttgcgcggcagctcgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55304 - RNA, 289 nt, synthetic construct
  source 1..289: mol_type = other RNA
cgctcttccgcgtctcttaagcttgcgcggcagccattcgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55305 - RNA, 289 nt, synthetic construct
  source 1..289: mol_type = other RNA
cgctcttccgcgtctcttaagcttgcgcggcagccatatgtcgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55306 - RNA, 289 nt, synthetic construct
  source 1..289: mol_type = other RNA
cgctcttccgcgtctcttaagcttgcgcggcagccatatgggctcgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55307 - RNA, 289 nt, synthetic construct
  source 1..289: mol_type = other RNA
cgctcttccgcgtctcttaagcttgcgcggcagccatatgggcccttcggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55308 - RNA, 289 nt, synthetic construct
  source 1..289: mol_type = other RNA
cgctcttccgcgtctcttaagcttgcgcggcagccatatgggccctatgtcgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55309 - RNA, 289 nt, synthetic construct
  source 1..289: mol_type = other RNA
cgctcttccgcgtctcttaagcttgcgcggcagccatatgggccctatggagtcgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55310 - RNA, 289 nt, synthetic construct
  source 1..289: mol_type = other RNA
cgctcttccgcgtctcttaagcttgcgcggcagccatatgggccctatggagatatcgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55311 - RNA, 289 nt, synthetic construct
  source 1..289: mol_type = other RNA
cgctcttccgcgtctcttaagcttgcgcggcagccatatgggccctatggagatatactcgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55312 - RNA, 289 nt, synthetic construct
  source 1..289: mol_type = other RNA
cgctcttccgcgtctcttaagcttgcgcggcagccatatgggccctatggagatatacaagtcggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55313 - RNA, 289 nt, synthetic construct
  source 1..289: mol_type = other RNA
cgctcttccgcgtctcttaagcttgcgcggcagccatatgggccctatggagatatacaagacatcgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55314 - RNA, 289 nt, synthetic construct
  source 1..289: mol_type = other RNA
cgctcttccgcgtctcttaagcttgcgcggcagccatatgggccctatggagatatacaagacagtgtcggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55315 - RNA, 289 nt, synthetic construct
  source 1..289: mol_type = other RNA
cgctcttccgcgtctcttaagcttgcgcggcagccatatgggccctatggagatatacaagacagtgtcttcgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55316 - RNA, 289 nt, synthetic construct
  source 1..289: mol_type = other RNA
cgctcttccgcgtctcttaagcttgcgcggcagccatatgggccctatggagatatacaagacagtgtctgcatcgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55317 - RNA, 289 nt, synthetic construct
  source 1..289: mol_type = other RNA
cgctcttccgcgtctcttaagcttgcgcggcagccatatgggccctatggagatatacaagacagtgtctgcatggtcgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55318 - RNA, 289 nt, synthetic construct
  source 1..289: mol_type = other RNA
cgctcttccgcgtctcttaagcttgcgcggcagccatatgggccctatggagatatacaagacagtgtctgcatggaagtcgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55319 - RNA, 289 nt, synthetic construct
  source 1..289: mol_type = other RNA
cgctcttccgcgtctcttaagcttgcgcggcagccatatgggccctatggagatatacaagacagtgtctgcatggaagagatcgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55320 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtcggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55321 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccatcgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55322 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtcggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55323 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtcgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55324 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatcgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55325 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtcgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55326 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctcgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55327 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctcgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55328 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctcgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55329 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatcgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55330 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactcggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55331 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctcgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55332 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactcggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55333 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtcgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55334 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatcgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55335 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatcgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55336 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtcgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55337 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttcgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55338 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtcgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55339 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctcgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55340 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctcggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55341 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtcgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55342 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatcgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55343 - RNA, 289 nt, synthetic construct
  source 1..289: mol_type = other RNA
cgctcttccgcgtctcttaagctcccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55344 - RNA, 289 nt, synthetic construct
  source 1..289: mol_type = other RNA
cgctcttccgcgtctcttaagcttgtccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55345 - RNA, 289 nt, synthetic construct
  source 1..289: mol_type = other RNA
cgctcttccgcgtctcttaagcttgcgctccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55346 - RNA, 289 nt, synthetic construct
  source 1..289: mol_type = other RNA
cgctcttccgcgtctcttaagcttgcgcggctcccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55347 - RNA, 289 nt, synthetic construct
  source 1..289: mol_type = other RNA
cgctcttccgcgtctcttaagcttgcgcggcagctccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55348 - RNA, 289 nt, synthetic construct
  source 1..289: mol_type = other RNA
cgctcttccgcgtctcttaagcttgcgcggcagccattccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55349 - RNA, 289 nt, synthetic construct
  source 1..289: mol_type = other RNA
cgctcttccgcgtctcttaagcttgcgcggcagccatatgtcccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55350 - RNA, 289 nt, synthetic construct
  source 1..289: mol_type = other RNA
cgctcttccgcgtctcttaagcttgcgcggcagccatatgggctccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55351 - RNA, 289 nt, synthetic construct
  source 1..289: mol_type = other RNA
cgctcttccgcgtctcttaagcttgcgcggcagccatatgggcccttccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55352 - RNA, 289 nt, synthetic construct
  source 1..289: mol_type = other RNA
cgctcttccgcgtctcttaagcttgcgcggcagccatatgggccctatgtccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55353 - RNA, 289 nt, synthetic construct
  source 1..289: mol_type = other RNA
cgctcttccgcgtctcttaagcttgcgcggcagccatatgggccctatggagtcctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55354 - RNA, 289 nt, synthetic construct
  source 1..289: mol_type = other RNA
cgctcttccgcgtctcttaagcttgcgcggcagccatatgggccctatggagatatccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55355 - RNA, 289 nt, synthetic construct
  source 1..289: mol_type = other RNA
cgctcttccgcgtctcttaagcttgcgcggcagccatatgggccctatggagatatactccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55356 - RNA, 289 nt, synthetic construct
  source 1..289: mol_type = other RNA
cgctcttccgcgtctcttaagcttgcgcggcagccatatgggccctatggagatatacaagtccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55357 - RNA, 289 nt, synthetic construct
  source 1..289: mol_type = other RNA
cgctcttccgcgtctcttaagcttgcgcggcagccatatgggccctatggagatatacaagacatcctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55358 - RNA, 289 nt, synthetic construct
  source 1..289: mol_type = other RNA
cgctcttccgcgtctcttaagcttgcgcggcagccatatgggccctatggagatatacaagacagtgtccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55359 - RNA, 289 nt, synthetic construct
  source 1..289: mol_type = other RNA
cgctcttccgcgtctcttaagcttgcgcggcagccatatgggccctatggagatatacaagacagtgtcttcctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55360 - RNA, 289 nt, synthetic construct
  source 1..289: mol_type = other RNA
cgctcttccgcgtctcttaagcttgcgcggcagccatatgggccctatggagatatacaagacagtgtctgcatccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55361 - RNA, 289 nt, synthetic construct
  source 1..289: mol_type = other RNA
cgctcttccgcgtctcttaagcttgcgcggcagccatatgggccctatggagatatacaagacagtgtctgcatggtccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55362 - RNA, 289 nt, synthetic construct
  source 1..289: mol_type = other RNA
cgctcttccgcgtctcttaagcttgcgcggcagccatatgggccctatggagatatacaagacagtgtctgcatggaagtcccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55363 - RNA, 289 nt, synthetic construct
  source 1..289: mol_type = other RNA
cgctcttccgcgtctcttaagcttgcgcggcagccatatgggccctatggagatatacaagacagtgtctgcatggaagagatccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55364 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagtccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55365 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccatcccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55366 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgtccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55367 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggtccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55368 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtatccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55369 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgtccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55370 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagctccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55371 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctctccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55372 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttctccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55373 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagatccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55374 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaactccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55375 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatctccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55376 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgactccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55377 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55378 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55379 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55380 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55381 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55382 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55383 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55384 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55385 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55386 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55387 - RNA, 289 nt, synthetic construct
  source 1..289: mol_type = other RNA
cgctcttccgcgtctcttaagcgagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55388 - RNA, 289 nt, synthetic construct
  source 1..289: mol_type = other RNA
cgctcttccgcgtctcttaagcttggagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55389 - RNA, 289 nt, synthetic construct
  source 1..289: mol_type = other RNA
cgctcttccgcgtctcttaagcttgcgcgagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55390 - RNA, 289 nt, synthetic construct
  source 1..289: mol_type = other RNA
cgctcttccgcgtctcttaagcttgcgcggcgagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55391 - RNA, 289 nt, synthetic construct
  source 1..289: mol_type = other RNA
cgctcttccgcgtctcttaagcttgcgcggcagcgagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55392 - RNA, 289 nt, synthetic construct
  source 1..289: mol_type = other RNA
cgctcttccgcgtctcttaagcttgcgcggcagccatgagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55393 - RNA, 289 nt, synthetic construct
  source 1..289: mol_type = other RNA
cgctcttccgcgtctcttaagcttgcgcggcagccatatggagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55394 - RNA, 289 nt, synthetic construct
  source 1..289: mol_type = other RNA
cgctcttccgcgtctcttaagcttgcgcggcagccatatgggcgagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55395 - RNA, 289 nt, synthetic construct
  source 1..289: mol_type = other RNA
cgctcttccgcgtctcttaagcttgcgcggcagccatatgggccctgaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55396 - RNA, 289 nt, synthetic construct; identical to SEQ ID NO: 54695
  source 1..289: mol_type = other RNA

SEQ ID NO: 55397 - RNA, 289 nt, synthetic construct
  source 1..289: mol_type = other RNA
cgctcttccgcgtctcttaagcttgcgcggcagccatatgggccctatggaggagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55398 - RNA, 289 nt, synthetic construct
  source 1..289: mol_type = other RNA
cgctcttccgcgtctcttaagcttgcgcggcagccatatgggccctatggagatagagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55399 - RNA, 289 nt, synthetic construct
  source 1..289: mol_type = other RNA
cgctcttccgcgtctcttaagcttgcgcggcagccatatgggccctatggagatatacgagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55400 - RNA, 289 nt, synthetic construct
  source 1..289: mol_type = other RNA
cgctcttccgcgtctcttaagcttgcgcggcagccatatgggccctatggagatatacaaggaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55401 - RNA, 289 nt, synthetic construct
  source 1..289: mol_type = other RNA
cgctcttccgcgtctcttaagcttgcgcggcagccatatgggccctatggagatatacaagacagagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55402 - RNA, 289 nt, synthetic construct
  source 1..289: mol_type = other RNA
cgctcttccgcgtctcttaagcttgcgcggcagccatatgggccctatggagatatacaagacagtggaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55403 - RNA, 289 nt, synthetic construct
  source 1..289: mol_type = other RNA
cgctcttccgcgtctcttaagcttgcgcggcagccatatgggccctatggagatatacaagacagtgtctgagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55404 - RNA, 289 nt, synthetic construct
  source 1..289: mol_type = other RNA
cgctcttccgcgtctcttaagcttgcgcggcagccatatgggccctatggagatatacaagacagtgtctgcagagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55405 - RNA, 289 nt, synthetic construct
  source 1..289: mol_type = other RNA
cgctcttccgcgtctcttaagcttgcgcggcagccatatgggccctatggagatatacaagacagtgtctgcatgggagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55406 - RNA, 289 nt, synthetic construct
  source 1..289: mol_type = other RNA
cgctcttccgcgtctcttaagcttgcgcggcagccatatgggccctatggagatatacaagacagtgtctgcatggaaggagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55407 - RNA, 289 nt, synthetic construct
  source 1..289: mol_type = other RNA
cgctcttccgcgtctcttaagcttgcgcggcagccatatgggccctatggagatatacaagacagtgtctgcatggaagagagagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55408 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55409 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55410 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55411 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55412 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55413 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55414 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55415 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55416 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55417 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55418 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55419 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55420 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55421 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55422 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55423 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55424 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55425 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55426 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55427 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55428 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55429 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55430 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55431 - RNA, 289 nt, synthetic construct
  source 1..289: mol_type = other RNA
cgctcttccgcgtctcttaagcgaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55432 - RNA, 289 nt, synthetic construct
  source 1..289: mol_type = other RNA
cgctcttccgcgtctcttaagcttggacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55433 - RNA, 289 nt, synthetic construct
  source 1..289: mol_type = other RNA
cgctcttccgcgtctcttaagcttgcgcgacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55434 - RNA, 289 nt, synthetic construct
  source 1..289: mol_type = other RNA
cgctcttccgcgtctcttaagcttgcgcggcgaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55435 - RNA, 289 nt, synthetic construct
  source 1..289: mol_type = other RNA
cgctcttccgcgtctcttaagcttgcgcggcagcgacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55436 - RNA, 289 nt, synthetic construct
  source 1..289: mol_type = other RNA
cgctcttccgcgtctcttaagcttgcgcggcagccatgacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55437 - RNA, 289 nt, synthetic construct
  source 1..289: mol_type = other RNA
cgctcttccgcgtctcttaagcttgcgcggcagccatatggaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55438 - RNA, 289 nt, synthetic construct
  source 1..289: mol_type = other RNA
cgctcttccgcgtctcttaagcttgcgcggcagccatatgggcgacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55439 - RNA, 289 nt, synthetic construct
  source 1..289: mol_type = other RNA
cgctcttccgcgtctcttaagcttgcgcggcagccatatgggccctgacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55440 - RNA, 289 nt, synthetic construct
  source 1..289: mol_type = other RNA
cgctcttccgcgtctcttaagcttgcgcggcagccatatgggccctatggacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55441 - RNA, 289 nt, synthetic construct
  source 1..289: mol_type = other RNA
cgctcttccgcgtctcttaagcttgcgcggcagccatatgggccctatggaggactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55442 - RNA, 289 nt, synthetic construct
  source 1..289: mol_type = other RNA
cgctcttccgcgtctcttaagcttgcgcggcagccatatgggccctatggagatagacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55443 - RNA, 289 nt, synthetic construct
  source 1..289: mol_type = other RNA
cgctcttccgcgtctcttaagcttgcgcggcagccatatgggccctatggagatatacgacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55444 - RNA, 289 nt, synthetic construct
  source 1..289: mol_type = other RNA
cgctcttccgcgtctcttaagcttgcgcggcagccatatgggccctatggagatatacaaggacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55445 - RNA, 289 nt, synthetic construct
  source 1..289: mol_type = other RNA
cgctcttccgcgtctcttaagcttgcgcggcagccatatgggccctatggagatatacaagacagactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55446 - RNA, 289 nt, synthetic construct
  source 1..289: mol_type = other RNA
cgctcttccgcgtctcttaagcttgcgcggcagccatatgggccctatggagatatacaagacagtggacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55447 - RNA, 289 nt, synthetic construct
  source 1..289: mol_type = other RNA
cgctcttccgcgtctcttaagcttgcgcggcagccatatgggccctatggagatatacaagacagtgtctgactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55448 - RNA, 289 nt, synthetic construct
  source 1..289: mol_type = other RNA
cgctcttccgcgtctcttaagcttgcgcggcagccatatgggccctatggagatatacaagacagtgtctgcagacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55449 - RNA, 289 nt, synthetic construct
  source 1..289: mol_type = other RNA
cgctcttccgcgtctcttaagcttgcgcggcagccatatgggccctatggagatatacaagacagtgtctgcatgggacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55450 - RNA, 289 nt, synthetic construct
  source 1..289: mol_type = other RNA
cgctcttccgcgtctcttaagcttgcgcggcagccatatgggccctatggagatatacaagacagtgtctgcatggaaggaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55451 - RNA, 289 nt, synthetic construct
  source 1..289: mol_type = other RNA
cgctcttccgcgtctcttaagcttgcgcggcagccatatgggccctatggagatatacaagacagtgtctgcatggaagagagacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55452 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55453 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55454 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55455 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55456 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55457 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55458 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55459 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55460 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55461 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55462 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55463 - RNA, 289 nt, synthetic construct; identical to SEQ ID NO: 54695
  source 1..289: mol_type = other RNA

SEQ ID NO: 55464 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55465 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55466 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55467 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55468 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55469 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55470 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55471 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55472 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55473 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55474 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55475 - RNA, 289 nt, synthetic construct
  source 1..289: mol_type = other RNA
cgctcttccgcgtctcttaagcgtgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55476 - RNA, 289 nt, synthetic construct
  source 1..289: mol_type = other RNA
cgctcttccgcgtctcttaagcttggtgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55477 - RNA, 289 nt, synthetic construct
  source 1..289: mol_type = other RNA
cgctcttccgcgtctcttaagcttgcgcgtgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55478 - RNA, 289 nt, synthetic construct
  source 1..289: mol_type = other RNA
cgctcttccgcgtctcttaagcttgcgcggcgtgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55479 - RNA, 289 nt, synthetic construct
  source 1..289: mol_type = other RNA
cgctcttccgcgtctcttaagcttgcgcggcagcgtgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55480 - RNA, 289 nt, synthetic construct
  source 1..289: mol_type = other RNA
cgctcttccgcgtctcttaagcttgcgcggcagccatgtgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55481 - RNA, 289 nt, synthetic construct
  source 1..289: mol_type = other RNA
cgctcttccgcgtctcttaagcttgcgcggcagccatatggtgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55482 - RNA, 289 nt, synthetic construct
  source 1..289: mol_type = other RNA
cgctcttccgcgtctcttaagcttgcgcggcagccatatgggcgtgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55483 - RNA, 289 nt, synthetic construct
  source 1..289: mol_type = other RNA
cgctcttccgcgtctcttaagcttgcgcggcagccatatgggccctgtggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55484 - RNA, 289 nt, synthetic construct
  source 1..289: mol_type = other RNA
cgctcttccgcgtctcttaagcttgcgcggcagccatatgggccctatggtgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55485 - RNA, 289 nt, synthetic construct
  source 1..289: mol_type = other RNA
cgctcttccgcgtctcttaagcttgcgcggcagccatatgggccctatggaggtgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55486 - RNA, 289 nt, synthetic construct
  source 1..289: mol_type = other RNA
cgctcttccgcgtctcttaagcttgcgcggcagccatatgggccctatggagatagtgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55487 - RNA, 289 nt, synthetic construct
  source 1..289: mol_type = other RNA
cgctcttccgcgtctcttaagcttgcgcggcagccatatgggccctatggagatatacgtgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55488 - RNA, 289 nt, synthetic construct
  source 1..289: mol_type = other RNA
cgctcttccgcgtctcttaagcttgcgcggcagccatatgggccctatggagatatacaaggtggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55489 - RNA, 289 nt, synthetic construct; identical to SEQ ID NO: 54695
  source 1..289: mol_type = other RNA

SEQ ID NO: 55490 - RNA, 289 nt, synthetic construct
  source 1..289: mol_type = other RNA
cgctcttccgcgtctcttaagcttgcgcggcagccatatgggccctatggagatatacaagacagtggtggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55491 - RNA, 289 nt, synthetic construct
  source 1..289: mol_type = other RNA
cgctcttccgcgtctcttaagcttgcgcggcagccatatgggccctatggagatatacaagacagtgtctgtgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55492 - RNA, 289 nt, synthetic construct
  source 1..289: mol_type = other RNA
cgctcttccgcgtctcttaagcttgcgcggcagccatatgggccctatggagatatacaagacagtgtctgcagtgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55493 - RNA, 289 nt, synthetic construct
  source 1..289: mol_type = other RNA
cgctcttccgcgtctcttaagcttgcgcggcagccatatgggccctatggagatatacaagacagtgtctgcatgggtgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55494 - RNA, 289 nt, synthetic construct
  source 1..289: mol_type = other RNA
cgctcttccgcgtctcttaagcttgcgcggcagccatatgggccctatggagatatacaagacagtgtctgcatggaaggtgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55495 - RNA, 289 nt, synthetic construct
  source 1..289: mol_type = other RNA
cgctcttccgcgtctcttaagcttgcgcggcagccatatgggccctatggagatatacaagacagtgtctgcatggaagagagtgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55496 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggtggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55497 - RNA, 289 nt, synthetic construct; identical to SEQ ID NO: 54695
  source 1..289: mol_type = other RNA

SEQ ID NO: 55498 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggtggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55499 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55500 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagtgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55501 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggtgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55502 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgtgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55503 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgtgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55504 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgtgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55505 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagtgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55506 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgtggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55507 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgtgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55508 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgtggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55509 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55510 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagtgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55511 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagtgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55512 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggtgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55513 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgtgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55514 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggtgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55515 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgtgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55516 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgtggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55517 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggtgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55518 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagtgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55519 - RNA, 289 nt, synthetic construct
  source 1..289: mol_type = other RNA
cgctcttccgcgtctcttaagcgtccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55520 - RNA, 289 nt, synthetic construct
  source 1..289: mol_type = other RNA
cgctcttccgcgtctcttaagcttggtcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55521 - RNA, 289 nt, synthetic construct
  source 1..289: mol_type = other RNA
cgctcttccgcgtctcttaagcttgcgcgtcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55522 - RNA, 289 nt, synthetic construct
  source 1..289: mol_type = other RNA
cgctcttccgcgtctcttaagcttgcgcggcgtccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55523 - RNA, 289 nt, synthetic construct
  source 1..289: mol_type = other RNA
cgctcttccgcgtctcttaagcttgcgcggcagcgtcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55524 - RNA, 289 nt, synthetic construct
  source 1..289: mol_type = other RNA
cgctcttccgcgtctcttaagcttgcgcggcagccatgtcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55525 - RNA, 289 nt, synthetic construct
  source 1..289: mol_type = other RNA
cgctcttccgcgtctcttaagcttgcgcggcagccatatggtccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55526 - RNA, 289 nt, synthetic construct
  source 1..289: mol_type = other RNA
cgctcttccgcgtctcttaagcttgcgcggcagccatatgggcgtcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55527 - RNA, 289 nt, synthetic construct
  source 1..289: mol_type = other RNA
cgctcttccgcgtctcttaagcttgcgcggcagccatatgggccctgtcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55528 - RNA, 289 nt, synthetic construct
  source 1..289: mol_type = other RNA
cgctcttccgcgtctcttaagcttgcgcggcagccatatgggccctatggtcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55529 - RNA, 289 nt, synthetic construct
  source 1..289: mol_type = other RNA
cgctcttccgcgtctcttaagcttgcgcggcagccatatgggccctatggaggtctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55530 - RNA, 289 nt, synthetic construct
  source 1..289: mol_type = other RNA
cgctcttccgcgtctcttaagcttgcgcggcagccatatgggccctatggagatagtcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55531 - RNA, 289 nt, synthetic construct
  source 1..289: mol_type = other RNA
cgctcttccgcgtctcttaagcttgcgcggcagccatatgggccctatggagatatacgtcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55532 - RNA, 289 nt, synthetic construct
  source 1..289: mol_type = other RNA
cgctcttccgcgtctcttaagcttgcgcggcagccatatgggccctatggagatatacaaggtcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55533 - RNA, 289 nt, synthetic construct
  source 1..289: mol_type = other RNA
cgctcttccgcgtctcttaagcttgcgcggcagccatatgggccctatggagatatacaagacagtctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55534 - RNA, 289 nt, synthetic construct
  source 1..289: mol_type = other RNA
cgctcttccgcgtctcttaagcttgcgcggcagccatatgggccctatggagatatacaagacagtggtcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55535 - RNA, 289 nt, synthetic construct
  source 1..289: mol_type = other RNA
cgctcttccgcgtctcttaagcttgcgcggcagccatatgggccctatggagatatacaagacagtgtctgtctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55536 - RNA, 289 nt, synthetic construct
  source 1..289: mol_type = other RNA
cgctcttccgcgtctcttaagcttgcgcggcagccatatgggccctatggagatatacaagacagtgtctgcagtcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55537 - RNA, 289 nt, synthetic construct
  source 1..289: mol_type = other RNA
cgctcttccgcgtctcttaagcttgcgcggcagccatatgggccctatggagatatacaagacagtgtctgcatgggtcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55538 - RNA, 289 nt, synthetic construct
  source 1..289: mol_type = other RNA
cgctcttccgcgtctcttaagcttgcgcggcagccatatgggccctatggagatatacaagacagtgtctgcatggaaggtccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55539 - RNA, 289 nt, synthetic construct
  source 1..289: mol_type = other RNA
cgctcttccgcgtctcttaagcttgcgcggcagccatatgggccctatggagatatacaagacagtgtctgcatggaagagagtcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55540 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggtcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55541 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55542 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggtcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55543 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55544 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagtcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55545 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggtcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55546 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgtcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55547 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgtcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55548 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgtcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55549 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagtcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55550 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgtcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55551 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgtcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55552 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgtcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55553 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55554 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagtcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55555 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagtcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55556 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggtcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55557 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgtcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55558 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggtcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55559 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgtcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55560 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgtcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55561 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggtcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55562 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagtcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55563 - RNA, 289 nt, synthetic construct
  source 1..289: mol_type = other RNA
cgctcttccgcgtctcttaagcgggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55564 - RNA, 289 nt, synthetic construct
  source 1..289: mol_type = other RNA
cgctcttccgcgtctcttaagcttggggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55565 - RNA, 289 nt, synthetic construct
  source 1..289: mol_type = other RNA
cgctcttccgcgtctcttaagcttgcgcgggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55566 - RNA, 289 nt, synthetic construct
  source 1..289: mol_type = other RNA
cgctcttccgcgtctcttaagcttgcgcggcgggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55567 - RNA, 289 nt, synthetic construct
  source 1..289: mol_type = other RNA
cgctcttccgcgtctcttaagcttgcgcggcagcgggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55568 - RNA, 289 nt, synthetic construct
  source 1..289: mol_type = other RNA
cgctcttccgcgtctcttaagcttgcgcggcagccatgggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55569 - RNA, 289 nt, synthetic construct
  source 1..289: mol_type = other RNA
cgctcttccgcgtctcttaagcttgcgcggcagccatatggggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55570 - RNA, 289 nt, synthetic construct
  source 1..289: mol_type = other RNA
cgctcttccgcgtctcttaagcttgcgcggcagccatatgggcgggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55571 - RNA, 289 nt, synthetic construct
  source 1..289: mol_type = other RNA
cgctcttccgcgtctcttaagcttgcgcggcagccatatgggccctggggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55572 - RNA, 289 nt, synthetic construct
  source 1..289: mol_type = other RNA
cgctcttccgcgtctcttaagcttgcgcggcagccatatgggccctatggggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55573 - RNA, 289 nt, synthetic construct
  source 1..289: mol_type = other RNA
cgctcttccgcgtctcttaagcttgcgcggcagccatatgggccctatggaggggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55574 - RNA, 289 nt, synthetic construct
  source 1..289: mol_type = other RNA
cgctcttccgcgtctcttaagcttgcgcggcagccatatgggccctatggagatagggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55575 - RNA, 289 nt, synthetic construct
  source 1..289: mol_type = other RNA
cgctcttccgcgtctcttaagcttgcgcggcagccatatgggccctatggagatatacgggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55576 - RNA, 289 nt, synthetic construct
  source 1..289: mol_type = other RNA
cgctcttccgcgtctcttaagcttgcgcggcagccatatgggccctatggagatatacaagggggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55577 - RNA, 289 nt, synthetic construct
  source 1..289: mol_type = other RNA
cgctcttccgcgtctcttaagcttgcgcggcagccatatgggccctatggagatatacaagacagggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55578 - RNA, 289 nt, synthetic construct
  source 1..289: mol_type = other RNA
cgctcttccgcgtctcttaagcttgcgcggcagccatatgggccctatggagatatacaagacagtgggggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55579 - RNA, 289 nt, synthetic construct
  source 1..289: mol_type = other RNA
cgctcttccgcgtctcttaagcttgcgcggcagccatatgggccctatggagatatacaagacagtgtctgggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55580 - RNA, 289 nt, synthetic construct
  source 1..289: mol_type = other RNA
cgctcttccgcgtctcttaagcttgcgcggcagccatatgggccctatggagatatacaagacagtgtctgcagggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55581 - RNA, 289 nt, synthetic construct
  source 1..289: mol_type = other RNA
cgctcttccgcgtctcttaagcttgcgcggcagccatatgggccctatggagatatacaagacagtgtctgcatgggggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55582 - RNA, 289 nt, synthetic construct
  source 1..289: mol_type = other RNA
cgctcttccgcgtctcttaagcttgcgcggcagccatatgggccctatggagatatacaagacagtgtctgcatggaaggggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55583 - RNA, 289 nt, synthetic construct
  source 1..289: mol_type = other RNA
cgctcttccgcgtctcttaagcttgcgcggcagccatatgggccctatggagatatacaagacagtgtctgcatggaagagagggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55584 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagggggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55585 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55586 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgggggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55587 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55588 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55589 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55590 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55591 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55592 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55593 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55594 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacggggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55595 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55596 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacggggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55597 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55598 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55599 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55600 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55601 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55602 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55603 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55604 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcggggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55605 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55606 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55607 - RNA, 289 nt, synthetic construct
  source 1..289: mol_type = other RNA
cgctcttccgcgtctcttaagcggccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55608 - RNA, 289 nt, synthetic construct
  source 1..289: mol_type = other RNA
cgctcttccgcgtctcttaagcttgggcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55609 - RNA, 289 nt, synthetic construct; identical to SEQ ID NO: 54695
  source 1..289: mol_type = other RNA

SEQ ID NO: 55610 - RNA, 289 nt, synthetic construct
  source 1..289: mol_type = other RNA
cgctcttccgcgtctcttaagcttgcgcggcggccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55611 - RNA, 289 nt, synthetic construct
  source 1..289: mol_type = other RNA
cgctcttccgcgtctcttaagcttgcgcggcagcggcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55612 - RNA, 289 nt, synthetic construct
  source 1..289: mol_type = other RNA
cgctcttccgcgtctcttaagcttgcgcggcagccatggcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55613 - RNA, 289 nt, synthetic construct; identical to SEQ ID NO: 54695
  source 1..289: mol_type = other RNA

SEQ ID NO: 55614 - RNA, 289 nt, synthetic construct
  source 1..289: mol_type = other RNA
cgctcttccgcgtctcttaagcttgcgcggcagccatatgggcggcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55615 - RNA, 289 nt, synthetic construct
  source 1..289: mol_type = other RNA
cgctcttccgcgtctcttaagcttgcgcggcagccatatgggccctggcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55616 - RNA, 289 nt, synthetic construct
  source 1..289: mol_type = other RNA
cgctcttccgcgtctcttaagcttgcgcggcagccatatgggccctatgggcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55617 - RNA, 289 nt, synthetic construct
  source 1..289: mol_type = other RNA
cgctcttccgcgtctcttaagcttgcgcggcagccatatgggccctatggagggctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55618 - RNA, 289 nt, synthetic construct
  source 1..289: mol_type = other RNA
cgctcttccgcgtctcttaagcttgcgcggcagccatatgggccctatggagataggcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55619 - RNA, 289 nt, synthetic construct
  source 1..289: mol_type = other RNA
cgctcttccgcgtctcttaagcttgcgcggcagccatatgggccctatggagatatacggcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55620 - RNA, 289 nt, synthetic construct
  source 1..289: mol_type = other RNA
cgctcttccgcgtctcttaagcttgcgcggcagccatatgggccctatggagatatacaagggcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55621 - RNA, 289 nt, synthetic construct
  source 1..289: mol_type = other RNA
cgctcttccgcgtctcttaagcttgcgcggcagccatatgggccctatggagatatacaagacaggctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55622 - RNA, 289 nt, synthetic construct
  source 1..289: mol_type = other RNA
cgctcttccgcgtctcttaagcttgcgcggcagccatatgggccctatggagatatacaagacagtgggcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55623 - RNA, 289 nt, synthetic construct
  source 1..289: mol_type = other RNA
cgctcttccgcgtctcttaagcttgcgcggcagccatatgggccctatggagatatacaagacagtgtctggctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55624 - RNA, 289 nt, synthetic construct
  source 1..289: mol_type = other RNA
cgctcttccgcgtctcttaagcttgcgcggcagccatatgggccctatggagatatacaagacagtgtctgcaggcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55625 - RNA, 289 nt, synthetic construct
  source 1..289: mol_type = other RNA
cgctcttccgcgtctcttaagcttgcgcggcagccatatgggccctatggagatatacaagacagtgtctgcatggggcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55626 - RNA, 289 nt, synthetic construct
  source 1..289: mol_type = other RNA
cgctcttccgcgtctcttaagcttgcgcggcagccatatgggccctatggagatatacaagacagtgtctgcatggaagggccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55627 - RNA, 289 nt, synthetic construct
  source 1..289: mol_type = other RNA
cgctcttccgcgtctcttaagcttgcgcggcagccatatgggccctatggagatatacaagacagtgtctgcatggaagagaggcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55628 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagggcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55629 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaggccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55630 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgggcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55631 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggggcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55632 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaggcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55633 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgggcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55634 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcggcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55635 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcggcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55636 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcggcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55637 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaggcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55638 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacggcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55639 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcggcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55640 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacggcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55641 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagggcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55642 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaggcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55643 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaggcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55644 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagggcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55645 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtggcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55646 - RNA, 289 nt, synthetic construct; identical to SEQ ID NO: 54695
  source 1..289: mol_type = other RNA

SEQ ID NO: 55647 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcggcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55648 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcggcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55649 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgggcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55650 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaggcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55651 - RNA, 289 nt, synthetic construct
  source 1..289: mol_type = other RNA
cgctcttccgcgtctcttaagcgcgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55652 - RNA, 289 nt, synthetic construct
  source 1..289: mol_type = other RNA
cgctcttccgcgtctcttaagcttggcgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55653 - RNA, 289 nt, synthetic construct
  source 1..289: mol_type = other RNA
cgctcttccgcgtctcttaagcttgcgcgcgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55654 - RNA, 289 nt, synthetic construct
  source 1..289: mol_type = other RNA
cgctcttccgcgtctcttaagcttgcgcggcgcgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55655 - RNA, 289 nt, synthetic construct
  source 1..289: mol_type = other RNA
cgctcttccgcgtctcttaagcttgcgcggcagcgcgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55656 - RNA, 289 nt, synthetic construct
  source 1..289: mol_type = other RNA
cgctcttccgcgtctcttaagcttgcgcggcagccatgcgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55657 - RNA, 289 nt, synthetic construct
  source 1..289: mol_type = other RNA
cgctcttccgcgtctcttaagcttgcgcggcagccatatggcgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55658 - RNA, 289 nt, synthetic construct
  source 1..289: mol_type = other RNA
cgctcttccgcgtctcttaagcttgcgcggcagccatatgggcgcgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55659 - RNA, 289 nt, synthetic construct
  source 1..289: mol_type = other RNA
cgctcttccgcgtctcttaagcttgcgcggcagccatatgggccctgcggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55660 - RNA, 289 nt, synthetic construct
  source 1..289: mol_type = other RNA
cgctcttccgcgtctcttaagcttgcgcggcagccatatgggccctatggcgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55661 - RNA, 289 nt, synthetic construct
  source 1..289: mol_type = other RNA
cgctcttccgcgtctcttaagcttgcgcggcagccatatgggccctatggaggcgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55662 - RNA, 289 nt, synthetic construct
  source 1..289: mol_type = other RNA
cgctcttccgcgtctcttaagcttgcgcggcagccatatgggccctatggagatagcgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55663 - RNA, 289 nt, synthetic construct
  source 1..289: mol_type = other RNA
cgctcttccgcgtctcttaagcttgcgcggcagccatatgggccctatggagatatacgcgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55664 - RNA, 289 nt, synthetic construct
  source 1..289: mol_type = other RNA
cgctcttccgcgtctcttaagcttgcgcggcagccatatgggccctatggagatatacaaggcggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55665 - RNA, 289 nt, synthetic construct
  source 1..289: mol_type = other RNA
cgctcttccgcgtctcttaagcttgcgcggcagccatatgggccctatggagatatacaagacagcgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55666 - RNA, 289 nt, synthetic construct
  source 1..289: mol_type = other RNA
cgctcttccgcgtctcttaagcttgcgcggcagccatatgggccctatggagatatacaagacagtggcggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55667 - RNA, 289 nt, synthetic construct
  source 1..289: mol_type = other RNA
cgctcttccgcgtctcttaagcttgcgcggcagccatatgggccctatggagatatacaagacagtgtctgcgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55668 - RNA, 289 nt, synthetic construct
  source 1..289: mol_type = other RNA
cgctcttccgcgtctcttaagcttgcgcggcagccatatgggccctatggagatatacaagacagtgtctgcagcgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55669 - RNA, 289 nt, synthetic construct
  source 1..289: mol_type = other RNA
cgctcttccgcgtctcttaagcttgcgcggcagccatatgggccctatggagatatacaagacagtgtctgcatgggcgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55670 - RNA, 289 nt, synthetic construct
  source 1..289: mol_type = other RNA
cgctcttccgcgtctcttaagcttgcgcggcagccatatgggccctatggagatatacaagacagtgtctgcatggaaggcgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55671 - RNA, 289 nt, synthetic construct
  source 1..289: mol_type = other RNA
cgctcttccgcgtctcttaagcttgcgcggcagccatatgggccctatggagatatacaagacagtgtctgcatggaagagagcgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55672 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggcggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55673 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagcgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55674 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggcggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55675 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggcgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55676 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagcgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55677 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggcgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55678 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgcgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55679 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgcgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55680 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgcgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55681 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagcgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55682 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgcggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55683 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgcgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55684 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgcggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55685 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggcgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55686 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagcgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55687 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagcgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55688 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggcgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55689 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgcgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55690 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggcgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55691 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgcgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55692 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgcggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55693 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggcgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55694 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagcgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55695 - RNA, 289 nt, synthetic construct
  source 1..289: mol_type = other RNA
cgctcttccgcgtctcttaagcgcccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55696 - RNA, 289 nt, synthetic construct
  source 1..289: mol_type = other RNA
cgctcttccgcgtctcttaagcttggccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55697 - RNA, 289 nt, synthetic construct
  source 1..289: mol_type = other RNA
cgctcttccgcgtctcttaagcttgcgcgccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55698 - RNA, 289 nt, synthetic construct
  source 1..289: mol_type = other RNA
cgctcttccgcgtctcttaagcttgcgcggcgcccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55699 - RNA, 289 nt, synthetic construct
  source 1..289: mol_type = other RNA
cgctcttccgcgtctcttaagcttgcgcggcagcgccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55700 - RNA, 289 nt, synthetic construct
  source 1..289: mol_type = other RNA
cgctcttccgcgtctcttaagcttgcgcggcagccatgccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55701 - RNA, 289 nt, synthetic construct
  source 1..289: mol_type = other RNA
cgctcttccgcgtctcttaagcttgcgcggcagccatatggcccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55702 - RNA, 289 nt, synthetic construct
  source 1..289: mol_type = other RNA
cgctcttccgcgtctcttaagcttgcgcggcagccatatgggcgccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55703 - RNA, 289 nt, synthetic construct
  source 1..289: mol_type = other RNA
cgctcttccgcgtctcttaagcttgcgcggcagccatatgggccctgccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55704 - RNA, 289 nt, synthetic construct
  source 1..289: mol_type = other RNA
cgctcttccgcgtctcttaagcttgcgcggcagccatatgggccctatggccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55705 - RNA, 289 nt, synthetic construct
  source 1..289: mol_type = other RNA
cgctcttccgcgtctcttaagcttgcgcggcagccatatgggccctatggaggcctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55706 - RNA, 289 nt, synthetic construct
  source 1..289: mol_type = other RNA
cgctcttccgcgtctcttaagcttgcgcggcagccatatgggccctatggagatagccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55707 - RNA, 289 nt, synthetic construct
  source 1..289: mol_type = other RNA
cgctcttccgcgtctcttaagcttgcgcggcagccatatgggccctatggagatatacgccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55708 - RNA, 289 nt, synthetic construct
  source 1..289: mol_type = other RNA
cgctcttccgcgtctcttaagcttgcgcggcagccatatgggccctatggagatatacaaggccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55709 - RNA, 289 nt, synthetic construct
  source 1..289: mol_type = other RNA
cgctcttccgcgtctcttaagcttgcgcggcagccatatgggccctatggagatatacaagacagcctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55710 - RNA, 289 nt, synthetic construct
  source 1..289: mol_type = other RNA
cgctcttccgcgtctcttaagcttgcgcggcagccatatgggccctatggagatatacaagacagtggccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55711 - RNA, 289 nt, synthetic construct
  source 1..289: mol_type = other RNA
cgctcttccgcgtctcttaagcttgcgcggcagccatatgggccctatggagatatacaagacagtgtctgcctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55712 - RNA, 289 nt, synthetic construct
  source 1..289: mol_type = other RNA
cgctcttccgcgtctcttaagcttgcgcggcagccatatgggccctatggagatatacaagacagtgtctgcagccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55713 - RNA, 289 nt, synthetic construct
  source 1..289: mol_type = other RNA
cgctcttccgcgtctcttaagcttgcgcggcagccatatgggccctatggagatatacaagacagtgtctgcatgggccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55714 - RNA, 289 nt, synthetic construct
  source 1..289: mol_type = other RNA
cgctcttccgcgtctcttaagcttgcgcggcagccatatgggccctatggagatatacaagacagtgtctgcatggaaggcccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55715 - RNA, 289 nt, synthetic construct
  source 1..289: mol_type = other RNA
cgctcttccgcgtctcttaagcttgcgcggcagccatatgggccctatggagatatacaagacagtgtctgcatggaagagagccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55716 - RNA, 289 nt, synthetic construct
  source 1..289: mol_type = other RNA
cgctcttccgcgtctcttaagcttgcgcggcagccatatgggccctatggagatatacaagacagtgtctgcatggaagagacaggccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55717 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagcccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55718 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtggccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55719 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55720 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtagccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55721 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactggccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55722 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcgccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55723 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcgccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55724 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcgccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55725 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagagccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55726 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacgccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55727 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55728 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55729 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55730 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55731 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55732 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55733 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55734 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55735 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55736 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55737 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55738 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55739 - RNA, 289 nt, synthetic construct
  source 1..289: mol_type = other RNA
cgctcttccgcgtctcttaagccagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55740 - RNA, 289 nt, synthetic construct
  source 1..289: mol_type = other RNA
cgctcttccgcgtctcttaagcttgcagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55741 - RNA, 289 nt, synthetic construct
  source 1..289: mol_type = other RNA
cgctcttccgcgtctcttaagcttgcgccagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55742 - RNA, 289 nt, synthetic construct
  source 1..289: mol_type = other RNA
cgctcttccgcgtctcttaagcttgcgcggccagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55743 - RNA, 289 nt, synthetic construct
  source 1..289: mol_type = other RNA
cgctcttccgcgtctcttaagcttgcgcggcagccagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55744 - RNA, 289 nt, synthetic construct
  source 1..289: mol_type = other RNA
cgctcttccgcgtctcttaagcttgcgcggcagccatcagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55745 - RNA, 289 nt, synthetic construct
  source 1..289: mol_type = other RNA
cgctcttccgcgtctcttaagcttgcgcggcagccatatgcagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55746 - RNA, 289 nt, synthetic construct
  source 1..289: mol_type = other RNA
cgctcttccgcgtctcttaagcttgcgcggcagccatatgggccagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55747 - RNA, 289 nt, synthetic construct
  source 1..289: mol_type = other RNA
cgctcttccgcgtctcttaagcttgcgcggcagccatatgggccctcaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55748 - RNA, 289 nt, synthetic construct
  source 1..289: mol_type = other RNA
cgctcttccgcgtctcttaagcttgcgcggcagccatatgggccctatgcagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55749 - RNA, 289 nt, synthetic construct
  source 1..289: mol_type = other RNA
cgctcttccgcgtctcttaagcttgcgcggcagccatatgggccctatggagcagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55750 - RNA, 289 nt, synthetic construct
  source 1..289: mol_type = other RNA
cgctcttccgcgtctcttaagcttgcgcggcagccatatgggccctatggagatacagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55751 - RNA, 289 nt, synthetic construct
  source 1..289: mol_type = other RNA
cgctcttccgcgtctcttaagcttgcgcggcagccatatgggccctatggagatataccagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55752 - RNA, 289 nt, synthetic construct
  source 1..289: mol_type = other RNA
cgctcttccgcgtctcttaagcttgcgcggcagccatatgggccctatggagatatacaagcaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55753 - RNA, 289 nt, synthetic construct
  source 1..289: mol_type = other RNA
cgctcttccgcgtctcttaagcttgcgcggcagccatatgggccctatggagatatacaagacacagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55754 - RNA, 289 nt, synthetic construct
  source 1..289: mol_type = other RNA
cgctcttccgcgtctcttaagcttgcgcggcagccatatgggccctatggagatatacaagacagtgcaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55755 - RNA, 289 nt, synthetic construct
  source 1..289: mol_type = other RNA
cgctcttccgcgtctcttaagcttgcgcggcagccatatgggccctatggagatatacaagacagtgtctcagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55756 - RNA, 289 nt, synthetic construct
  source 1..289: mol_type = other RNA
cgctcttccgcgtctcttaagcttgcgcggcagccatatgggccctatggagatatacaagacagtgtctgcacagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55757 - RNA, 289 nt, synthetic construct
  source 1..289: mol_type = other RNA
cgctcttccgcgtctcttaagcttgcgcggcagccatatgggccctatggagatatacaagacagtgtctgcatggcagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55758 - RNA, 289 nt, synthetic construct
  source 1..289: mol_type = other RNA
cgctcttccgcgtctcttaagcttgcgcggcagccatatgggccctatggagatatacaagacagtgtctgcatggaagcagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55759 - RNA, 289 nt, synthetic construct; identical to SEQ ID NO: 54695
  source 1..289: mol_type = other RNA

SEQ ID NO: 55760 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagcaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55761 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccacagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55762 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55763 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggcagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55764 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtacagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55765 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgcagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55766 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagccagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55767 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctccagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55768 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttccagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55769 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagacagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55770 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaaccaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55771 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatccagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55772 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55773 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55774 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55775 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55776 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55777 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55778 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55779 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55780 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55781 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55782 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55783 - RNA, 289 nt, synthetic construct
  source 1..289: mol_type = other RNA
cgctcttccgcgtctcttaagccaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55784 - RNA, 289 nt, synthetic construct
  source 1..289: mol_type = other RNA
cgctcttccgcgtctcttaagcttgcacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55785 - RNA, 289 nt, synthetic construct
  source 1..289: mol_type = other RNA
cgctcttccgcgtctcttaagcttgcgccacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55786 - RNA, 289 nt, synthetic construct
  source 1..289: mol_type = other RNA
cgctcttccgcgtctcttaagcttgcgcggccaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55787 - RNA, 289 nt, synthetic construct
  source 1..289: mol_type = other RNA
cgctcttccgcgtctcttaagcttgcgcggcagccacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55788 - RNA, 289 nt, synthetic construct
  source 1..289: mol_type = other RNA
cgctcttccgcgtctcttaagcttgcgcggcagccatcacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55789 - RNA, 289 nt, synthetic construct
  source 1..289: mol_type = other RNA
cgctcttccgcgtctcttaagcttgcgcggcagccatatgcaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55790 - RNA, 289 nt, synthetic construct
  source 1..289: mol_type = other RNA
cgctcttccgcgtctcttaagcttgcgcggcagccatatgggccacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55791 - RNA, 289 nt, synthetic construct
  source 1..289: mol_type = other RNA
cgctcttccgcgtctcttaagcttgcgcggcagccatatgggccctcacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55792 - RNA, 289 nt, synthetic construct
  source 1..289: mol_type = other RNA
cgctcttccgcgtctcttaagcttgcgcggcagccatatgggccctatgcacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55793 - RNA, 289 nt, synthetic construct
  source 1..289: mol_type = other RNA
cgctcttccgcgtctcttaagcttgcgcggcagccatatgggccctatggagcactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55794 - RNA, 289 nt, synthetic construct
  source 1..289: mol_type = other RNA
cgctcttccgcgtctcttaagcttgcgcggcagccatatgggccctatggagatacacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55795 - RNA, 289 nt, synthetic construct
  source 1..289: mol_type = other RNA
cgctcttccgcgtctcttaagcttgcgcggcagccatatgggccctatggagatataccacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55796 - RNA, 289 nt, synthetic construct
  source 1..289: mol_type = other RNA
cgctcttccgcgtctcttaagcttgcgcggcagccatatgggccctatggagatatacaagcacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55797 - RNA, 289 nt, synthetic construct
  source 1..289: mol_type = other RNA
cgctcttccgcgtctcttaagcttgcgcggcagccatatgggccctatggagatatacaagacacactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55798 - RNA, 289 nt, synthetic construct
  source 1..289: mol_type = other RNA
cgctcttccgcgtctcttaagcttgcgcggcagccatatgggccctatggagatatacaagacagtgcacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55799 - RNA, 289 nt, synthetic construct
  source 1..289: mol_type = other RNA
cgctcttccgcgtctcttaagcttgcgcggcagccatatgggccctatggagatatacaagacagtgtctcactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55800 - RNA, 289 nt, synthetic construct
  source 1..289: mol_type = other RNA
cgctcttccgcgtctcttaagcttgcgcggcagccatatgggccctatggagatatacaagacagtgtctgcacacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55801 - RNA, 289 nt, synthetic construct
  source 1..289: mol_type = other RNA
cgctcttccgcgtctcttaagcttgcgcggcagccatatgggccctatggagatatacaagacagtgtctgcatggcacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55802 - RNA, 289 nt, synthetic construct
  source 1..289: mol_type = other RNA
cgctcttccgcgtctcttaagcttgcgcggcagccatatgggccctatggagatatacaagacagtgtctgcatggaagcaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55803 - RNA, 289 nt, synthetic construct
  source 1..289: mol_type = other RNA
cgctcttccgcgtctcttaagcttgcgcggcagccatatgggccctatggagatatacaagacagtgtctgcatggaagagacacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55804 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagcacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55805 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccacaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55806 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55807 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggcacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55808 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtacacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55809 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgcacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55810 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagccacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55811 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctccacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55812 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttccacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55813 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagacacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55814 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaaccacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55815 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatccacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55816 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55817 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55818 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55819 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55820 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55821 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55822 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55823 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55824 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55825 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55826 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55827 - RNA, 289 nt, synthetic construct
  source 1..289: mol_type = other RNA
cgctcttccgcgtctcttaagcctgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55828 - RNA, 289 nt, synthetic construct
  source 1..289: mol_type = other RNA
cgctcttccgcgtctcttaagcttgctgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55829 - RNA, 289 nt, synthetic construct
  source 1..289: mol_type = other RNA
cgctcttccgcgtctcttaagcttgcgcctgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55830 - RNA, 289 nt, synthetic construct
  source 1..289: mol_type = other RNA
cgctcttccgcgtctcttaagcttgcgcggcctgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55831 - RNA, 289 nt, synthetic construct
  source 1..289: mol_type = other RNA
cgctcttccgcgtctcttaagcttgcgcggcagcctgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55832 - RNA, 289 nt, synthetic construct
  source 1..289: mol_type = other RNA
cgctcttccgcgtctcttaagcttgcgcggcagccatctgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55833 - RNA, 289 nt, synthetic construct
  source 1..289: mol_type = other RNA
cgctcttccgcgtctcttaagcttgcgcggcagccatatgctgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55834 - RNA, 289 nt, synthetic construct
  source 1..289: mol_type = other RNA
cgctcttccgcgtctcttaagcttgcgcggcagccatatgggcctgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55835 - RNA, 289 nt, synthetic construct
  source 1..289: mol_type = other RNA
cgctcttccgcgtctcttaagcttgcgcggcagccatatgggccctctggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55836 - RNA, 289 nt, synthetic construct
  source 1..289: mol_type = other RNA
cgctcttccgcgtctcttaagcttgcgcggcagccatatgggccctatgctgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55837 - RNA, 289 nt, synthetic construct
  source 1..289: mol_type = other RNA
cgctcttccgcgtctcttaagcttgcgcggcagccatatgggccctatggagctgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55838 - RNA, 289 nt, synthetic construct
  source 1..289: mol_type = other RNA
cgctcttccgcgtctcttaagcttgcgcggcagccatatgggccctatggagatactgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55839 - RNA, 289 nt, synthetic construct
  source 1..289: mol_type = other RNA
cgctcttccgcgtctcttaagcttgcgcggcagccatatgggccctatggagatatacctgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55840 - RNA, 289 nt, synthetic construct
  source 1..289: mol_type = other RNA
cgctcttccgcgtctcttaagcttgcgcggcagccatatgggccctatggagatatacaagctggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55841 - RNA, 289 nt, synthetic construct
  source 1..289: mol_type = other RNA
cgctcttccgcgtctcttaagcttgcgcggcagccatatgggccctatggagatatacaagacactgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55842 - RNA, 289 nt, synthetic construct
  source 1..289: mol_type = other RNA
cgctcttccgcgtctcttaagcttgcgcggcagccatatgggccctatggagatatacaagacagtgctggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55843 - RNA, 289 nt, synthetic construct
  source 1..289: mol_type = other RNA
cgctcttccgcgtctcttaagcttgcgcggcagccatatgggccctatggagatatacaagacagtgtctctgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55844 - RNA, 289 nt, synthetic construct
  source 1..289: mol_type = other RNA
cgctcttccgcgtctcttaagcttgcgcggcagccatatgggccctatggagatatacaagacagtgtctgcactgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55845 - RNA, 289 nt, synthetic construct
  source 1..289: mol_type = other RNA
cgctcttccgcgtctcttaagcttgcgcggcagccatatgggccctatggagatatacaagacagtgtctgcatggctgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55846 - RNA, 289 nt, synthetic construct
  source 1..289: mol_type = other RNA
cgctcttccgcgtctcttaagcttgcgcggcagccatatgggccctatggagatatacaagacagtgtctgcatggaagctgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55847 - RNA, 289 nt, synthetic construct
  source 1..289: mol_type = other RNA
cgctcttccgcgtctcttaagcttgcgcggcagccatatgggccctatggagatatacaagacagtgtctgcatggaagagactgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55848 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagctggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55849 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccactgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55850 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgctggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55851 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggctgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55852 - RNA, 289 nt, synthetic construct; identical to SEQ ID NO: 54695
  source 1..289: mol_type = other RNA

SEQ ID NO: 55853 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgctgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55854 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55855 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcctgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55856 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcctgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55857 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagactgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55858 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacctggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55859 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcctgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55860 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacctggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55861 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagctgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55862 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55863 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactactgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55864 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagctgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55865 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtctgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55866 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgctgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55867 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcctgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55868 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcctggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55869 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgctgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55870 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaactgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55871 - RNA, 289 nt, synthetic construct
  source 1..289: mol_type = other RNA
cgctcttccgcgtctcttaagcctccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55872 - RNA, 289 nt, synthetic construct
  source 1..289: mol_type = other RNA
cgctcttccgcgtctcttaagcttgctcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55873 - RNA, 289 nt, synthetic construct
  source 1..289: mol_type = other RNA
cgctcttccgcgtctcttaagcttgcgcctcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55874 - RNA, 289 nt, synthetic construct
  source 1..289: mol_type = other RNA
cgctcttccgcgtctcttaagcttgcgcggcctccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55875 - RNA, 289 nt, synthetic construct
  source 1..289: mol_type = other RNA
cgctcttccgcgtctcttaagcttgcgcggcagcctcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55876 - RNA, 289 nt, synthetic construct
  source 1..289: mol_type = other RNA
cgctcttccgcgtctcttaagcttgcgcggcagccatctcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55877 - RNA, 289 nt, synthetic construct
  source 1..289: mol_type = other RNA
cgctcttccgcgtctcttaagcttgcgcggcagccatatgctccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55878 - RNA, 289 nt, synthetic construct
  source 1..289: mol_type = other RNA
cgctcttccgcgtctcttaagcttgcgcggcagccatatgggcctcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55879 - RNA, 289 nt, synthetic construct
  source 1..289: mol_type = other RNA
cgctcttccgcgtctcttaagcttgcgcggcagccatatgggccctctcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55880 - RNA, 289 nt, synthetic construct
  source 1..289: mol_type = other RNA
cgctcttccgcgtctcttaagcttgcgcggcagccatatgggccctatgctcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55881 - RNA, 289 nt, synthetic construct
  source 1..289: mol_type = other RNA
cgctcttccgcgtctcttaagcttgcgcggcagccatatgggccctatggagctctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55882 - RNA, 289 nt, synthetic construct
  source 1..289: mol_type = other RNA
cgctcttccgcgtctcttaagcttgcgcggcagccatatgggccctatggagatactcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55883 - RNA, 289 nt, synthetic construct
  source 1..289: mol_type = other RNA
cgctcttccgcgtctcttaagcttgcgcggcagccatatgggccctatggagatatacctcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55884 - RNA, 289 nt, synthetic construct
  source 1..289: mol_type = other RNA
cgctcttccgcgtctcttaagcttgcgcggcagccatatgggccctatggagatatacaagctcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55885 - RNA, 289 nt, synthetic construct
  source 1..289: mol_type = other RNA
cgctcttccgcgtctcttaagcttgcgcggcagccatatgggccctatggagatatacaagacactctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55886 - RNA, 289 nt, synthetic construct
  source 1..289: mol_type = other RNA
cgctcttccgcgtctcttaagcttgcgcggcagccatatgggccctatggagatatacaagacagtgctcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55887 - RNA, 289 nt, synthetic construct
  source 1..289: mol_type = other RNA
cgctcttccgcgtctcttaagcttgcgcggcagccatatgggccctatggagatatacaagacagtgtctctctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55888 - RNA, 289 nt, synthetic construct
  source 1..289: mol_type = other RNA
cgctcttccgcgtctcttaagcttgcgcggcagccatatgggccctatggagatatacaagacagtgtctgcactcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55889 - RNA, 289 nt, synthetic construct
  source 1..289: mol_type = other RNA
cgctcttccgcgtctcttaagcttgcgcggcagccatatgggccctatggagatatacaagacagtgtctgcatggctcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55890 - RNA, 289 nt, synthetic construct
  source 1..289: mol_type = other RNA
cgctcttccgcgtctcttaagcttgcgcggcagccatatgggccctatggagatatacaagacagtgtctgcatggaagctccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55891 - RNA, 289 nt, synthetic construct
  source 1..289: mol_type = other RNA
cgctcttccgcgtctcttaagcttgcgcggcagccatatgggccctatggagatatacaagacagtgtctgcatggaagagactcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55892 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagctcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55893 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccactccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55894 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgctcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55895 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggctcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55896 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55897 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgctcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55898 - RNA, 289 nt, synthetic construct; identical to SEQ ID NO: 54695
  source 1..289: mol_type = other RNA

SEQ ID NO: 55899 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcctcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55900 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcctcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55901 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagactcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55902 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacctcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55903 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcctcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55904 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacctcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55905 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagctcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55906 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55907 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactactcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55908 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagctcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55909 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtctcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55910 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgctcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55911 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcctcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55912 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcctcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55913 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgctcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55914 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaactcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55915 - RNA, 289 nt, synthetic construct
  source 1..289: mol_type = other RNA
cgctcttccgcgtctcttaagccggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55916 - RNA, 289 nt, synthetic construct
  source 1..289: mol_type = other RNA
cgctcttccgcgtctcttaagcttgcggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55917 - RNA, 289 nt, synthetic construct
  source 1..289: mol_type = other RNA
cgctcttccgcgtctcttaagcttgcgccggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55918 - RNA, 289 nt, synthetic construct
  source 1..289: mol_type = other RNA
cgctcttccgcgtctcttaagcttgcgcggccggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55919 - RNA, 289 nt, synthetic construct
  source 1..289: mol_type = other RNA
cgctcttccgcgtctcttaagcttgcgcggcagccggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55920 - RNA, 289 nt, synthetic construct
  source 1..289: mol_type = other RNA
cgctcttccgcgtctcttaagcttgcgcggcagccatcggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55921 - RNA, 289 nt, synthetic construct
  source 1..289: mol_type = other RNA
cgctcttccgcgtctcttaagcttgcgcggcagccatatgcggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55922 - RNA, 289 nt, synthetic construct
  source 1..289: mol_type = other RNA
cgctcttccgcgtctcttaagcttgcgcggcagccatatgggccggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55923 - RNA, 289 nt, synthetic construct
  source 1..289: mol_type = other RNA
cgctcttccgcgtctcttaagcttgcgcggcagccatatgggccctcgggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55924 - RNA, 289 nt, synthetic construct
  source 1..289: mol_type = other RNA
cgctcttccgcgtctcttaagcttgcgcggcagccatatgggccctatgcggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55925 - RNA, 289 nt, synthetic construct
  source 1..289: mol_type = other RNA
cgctcttccgcgtctcttaagcttgcgcggcagccatatgggccctatggagcggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55926 - RNA, 289 nt, synthetic construct
  source 1..289: mol_type = other RNA
cgctcttccgcgtctcttaagcttgcgcggcagccatatgggccctatggagatacggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55927 - RNA, 289 nt, synthetic construct
  source 1..289: mol_type = other RNA
cgctcttccgcgtctcttaagcttgcgcggcagccatatgggccctatggagatataccggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55928 - RNA, 289 nt, synthetic construct
  source 1..289: mol_type = other RNA
cgctcttccgcgtctcttaagcttgcgcggcagccatatgggccctatggagatatacaagcgggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55929 - RNA, 289 nt, synthetic construct
  source 1..289: mol_type = other RNA
cgctcttccgcgtctcttaagcttgcgcggcagccatatgggccctatggagatatacaagacacggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55930 - RNA, 289 nt, synthetic construct
  source 1..289: mol_type = other RNA
cgctcttccgcgtctcttaagcttgcgcggcagccatatgggccctatggagatatacaagacagtgcgggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55931 - RNA, 289 nt, synthetic construct
  source 1..289: mol_type = other RNA
cgctcttccgcgtctcttaagcttgcgcggcagccatatgggccctatggagatatacaagacagtgtctcggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55932 - RNA, 289 nt, synthetic construct
  source 1..289: mol_type = other RNA
cgctcttccgcgtctcttaagcttgcgcggcagccatatgggccctatggagatatacaagacagtgtctgcacggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55933 - RNA, 289 nt, synthetic construct
  source 1..289: mol_type = other RNA
cgctcttccgcgtctcttaagcttgcgcggcagccatatgggccctatggagatatacaagacagtgtctgcatggcggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55934 - RNA, 289 nt, synthetic construct
  source 1..289: mol_type = other RNA
cgctcttccgcgtctcttaagcttgcgcggcagccatatgggccctatggagatatacaagacagtgtctgcatggaagcggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55935 - RNA, 289 nt, synthetic construct
  source 1..289: mol_type = other RNA
cgctcttccgcgtctcttaagcttgcgcggcagccatatgggccctatggagatatacaagacagtgtctgcatggaagagacggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55936 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagcgggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55937 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccacggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55938 - RNA, 289 nt, synthetic construct; identical to SEQ ID NO: 54695
  source 1..289: mol_type = other RNA

SEQ ID NO: 55939 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggcggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55940 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtacggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55941 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgcggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55942 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagccggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55943 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctccggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55944 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttccggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55945 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagacggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55946 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaaccgggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55947 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatccggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55948 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccgggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55949 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55950 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55951 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55952 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55953 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55954 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55955 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55956 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccgggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55957 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55958 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55959 - RNA, 289 nt, synthetic construct
  source 1..289: mol_type = other RNA
cgctcttccgcgtctcttaagccgccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55960 - RNA, 289 nt, synthetic construct; identical to SEQ ID NO: 54695
  source 1..289: mol_type = other RNA

SEQ ID NO: 55961 - RNA, 289 nt, synthetic construct
  source 1..289: mol_type = other RNA
cgctcttccgcgtctcttaagcttgcgccgcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55962 - RNA, 289 nt, synthetic construct
  source 1..289: mol_type = other RNA
cgctcttccgcgtctcttaagcttgcgcggccgccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55963 - RNA, 289 nt, synthetic construct
  source 1..289: mol_type = other RNA
cgctcttccgcgtctcttaagcttgcgcggcagccgcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55964 - RNA, 289 nt, synthetic construct
  source 1..289: mol_type = other RNA
cgctcttccgcgtctcttaagcttgcgcggcagccatcgcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55965 - RNA, 289 nt, synthetic construct
  source 1..289: mol_type = other RNA
cgctcttccgcgtctcttaagcttgcgcggcagccatatgcgccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55966 - RNA, 289 nt, synthetic construct
  source 1..289: mol_type = other RNA
cgctcttccgcgtctcttaagcttgcgcggcagccatatgggccgcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55967 - RNA, 289 nt, synthetic construct
  source 1..289: mol_type = other RNA
cgctcttccgcgtctcttaagcttgcgcggcagccatatgggccctcgcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55968 - RNA, 289 nt, synthetic construct
  source 1..289: mol_type = other RNA
cgctcttccgcgtctcttaagcttgcgcggcagccatatgggccctatgcgcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55969 - RNA, 289 nt, synthetic construct
  source 1..289: mol_type = other RNA
cgctcttccgcgtctcttaagcttgcgcggcagccatatgggccctatggagcgctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55970 - RNA, 289 nt, synthetic construct
  source 1..289: mol_type = other RNA
cgctcttccgcgtctcttaagcttgcgcggcagccatatgggccctatggagatacgcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55971 - RNA, 289 nt, synthetic construct
  source 1..289: mol_type = other RNA
cgctcttccgcgtctcttaagcttgcgcggcagccatatgggccctatggagatataccgcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55972 - RNA, 289 nt, synthetic construct
  source 1..289: mol_type = other RNA
cgctcttccgcgtctcttaagcttgcgcggcagccatatgggccctatggagatatacaagcgcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55973 - RNA, 289 nt, synthetic construct
  source 1..289: mol_type = other RNA
cgctcttccgcgtctcttaagcttgcgcggcagccatatgggccctatggagatatacaagacacgctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55974 - RNA, 289 nt, synthetic construct
  source 1..289: mol_type = other RNA
cgctcttccgcgtctcttaagcttgcgcggcagccatatgggccctatggagatatacaagacagtgcgcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55975 - RNA, 289 nt, synthetic construct
  source 1..289: mol_type = other RNA
cgctcttccgcgtctcttaagcttgcgcggcagccatatgggccctatggagatatacaagacagtgtctcgctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55976 - RNA, 289 nt, synthetic construct
  source 1..289: mol_type = other RNA
cgctcttccgcgtctcttaagcttgcgcggcagccatatgggccctatggagatatacaagacagtgtctgcacgcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55977 - RNA, 289 nt, synthetic construct
  source 1..289: mol_type = other RNA
cgctcttccgcgtctcttaagcttgcgcggcagccatatgggccctatggagatatacaagacagtgtctgcatggcgcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55978 - RNA, 289 nt, synthetic construct
  source 1..289: mol_type = other RNA
cgctcttccgcgtctcttaagcttgcgcggcagccatatgggccctatggagatatacaagacagtgtctgcatggaagcgccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55979 - RNA, 289 nt, synthetic construct
  source 1..289: mol_type = other RNA
cgctcttccgcgtctcttaagcttgcgcggcagccatatgggccctatggagatatacaagacagtgtctgcatggaagagacgcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55980 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagcgcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55981 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccacgccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55982 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55983 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggcgcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55984 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtacgcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55985 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgcgcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55986 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagccgcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55987 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctccgcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55988 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttccgcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55989 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagacgcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55990 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaaccgcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55991 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatccgcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55992 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccgcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55993 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcgcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55994 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacgcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55995 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacgcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55996 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcgcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55997 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcgcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55998 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcgcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 55999 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccgcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56000 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccgcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56001 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcgcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56002 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacgcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56003 - RNA, 289 nt, synthetic construct
  source 1..289: mol_type = other RNA
cgctcttccgcgtctcttaagcccgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56004 - RNA, 289 nt, synthetic construct
  source 1..289: mol_type = other RNA
cgctcttccgcgtctcttaagcttgccgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56005 - RNA, 289 nt, synthetic construct
  source 1..289: mol_type = other RNA
cgctcttccgcgtctcttaagcttgcgcccgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56006 - RNA, 289 nt, synthetic construct
  source 1..289: mol_type = other RNA
cgctcttccgcgtctcttaagcttgcgcggcccgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56007 - RNA, 289 nt, synthetic construct
  source 1..289: mol_type = other RNA
cgctcttccgcgtctcttaagcttgcgcggcagcccgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56008 - RNA, 289 nt, synthetic construct
  source 1..289: mol_type = other RNA
cgctcttccgcgtctcttaagcttgcgcggcagccatccgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56009 - RNA, 289 nt, synthetic construct
  source 1..289: mol_type = other RNA
cgctcttccgcgtctcttaagcttgcgcggcagccatatgccgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56010 - RNA, 289 nt, synthetic construct
  source 1..289: mol_type = other RNA
cgctcttccgcgtctcttaagcttgcgcggcagccatatgggcccgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56011 - RNA, 289 nt, synthetic construct
  source 1..289: mol_type = other RNA
cgctcttccgcgtctcttaagcttgcgcggcagccatatgggccctccggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56012 - RNA, 289 nt, synthetic construct
  source 1..289: mol_type = other RNA
cgctcttccgcgtctcttaagcttgcgcggcagccatatgggccctatgccgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56013 - RNA, 289 nt, synthetic construct
  source 1..289: mol_type = other RNA
cgctcttccgcgtctcttaagcttgcgcggcagccatatgggccctatggagccgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56014 - RNA, 289 nt, synthetic construct
  source 1..289: mol_type = other RNA
cgctcttccgcgtctcttaagcttgcgcggcagccatatgggccctatggagataccgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56015 - RNA, 289 nt, synthetic construct
  source 1..289: mol_type = other RNA
cgctcttccgcgtctcttaagcttgcgcggcagccatatgggccctatggagatatacccgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56016 - RNA, 289 nt, synthetic construct
  source 1..289: mol_type = other RNA
cgctcttccgcgtctcttaagcttgcgcggcagccatatgggccctatggagatatacaagccggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56017 - RNA, 289 nt, synthetic construct
  source 1..289: mol_type = other RNA
cgctcttccgcgtctcttaagcttgcgcggcagccatatgggccctatggagatatacaagacaccgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56018 - RNA, 289 nt, synthetic construct
  source 1..289: mol_type = other RNA
cgctcttccgcgtctcttaagcttgcgcggcagccatatgggccctatggagatatacaagacagtgccggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56019 - RNA, 289 nt, synthetic construct
  source 1..289: mol_type = other RNA
cgctcttccgcgtctcttaagcttgcgcggcagccatatgggccctatggagatatacaagacagtgtctccgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56020 - RNA, 289 nt, synthetic construct
  source 1..289: mol_type = other RNA
cgctcttccgcgtctcttaagcttgcgcggcagccatatgggccctatggagatatacaagacagtgtctgcaccgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56021 - RNA, 289 nt, synthetic construct
  source 1..289: mol_type = other RNA
cgctcttccgcgtctcttaagcttgcgcggcagccatatgggccctatggagatatacaagacagtgtctgcatggccgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56022 - RNA, 289 nt, synthetic construct
  source 1..289: mol_type = other RNA
cgctcttccgcgtctcttaagcttgcgcggcagccatatgggccctatggagatatacaagacagtgtctgcatggaagccgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56023 - RNA, 289 nt, synthetic construct
  source 1..289: mol_type = other RNA
cgctcttccgcgtctcttaagcttgcgcggcagccatatgggccctatggagatatacaagacagtgtctgcatggaagagaccgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56024 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56025 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaccgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56026 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgccggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56027 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggccgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56028 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtaccgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56029 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgccgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56030 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcccgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56031 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcccgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56032 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcccgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56033 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaccgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56034 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacccggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56035 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcccgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56036 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacccggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56037 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagccgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56038 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaccgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56039 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaccgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56040 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagccgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56041 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtccgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56042 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgccgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56043 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcccgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56044 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcccggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56045 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgccgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56046 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaccgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56047 - RNA, 289 nt, synthetic construct
  source 1..289: mol_type = other RNA
cgctcttccgcgtctcttaagcccccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56048 - RNA, 289 nt, synthetic construct
  source 1..289: mol_type = other RNA
cgctcttccgcgtctcttaagcttgcccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56049 - RNA, 289 nt, synthetic construct
  source 1..289: mol_type = other RNA
cgctcttccgcgtctcttaagcttgcgccccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56050 - RNA, 289 nt, synthetic construct
  source 1..289: mol_type = other RNA
cgctcttccgcgtctcttaagcttgcgcggcccccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56051 - RNA, 289 nt, synthetic construct
  source 1..289: mol_type = other RNA
cgctcttccgcgtctcttaagcttgcgcggcagccccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56052 - RNA, 289 nt, synthetic construct
  source 1..289: mol_type = other RNA
cgctcttccgcgtctcttaagcttgcgcggcagccatcccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56053 - RNA, 289 nt, synthetic construct
  source 1..289: mol_type = other RNA
cgctcttccgcgtctcttaagcttgcgcggcagccatatgccccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56054 - RNA, 289 nt, synthetic construct
  source 1..289: mol_type = other RNA
cgctcttccgcgtctcttaagcttgcgcggcagccatatgggccccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56055 - RNA, 289 nt, synthetic construct
  source 1..289: mol_type = other RNA
cgctcttccgcgtctcttaagcttgcgcggcagccatatgggccctcccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56056 - RNA, 289 nt, synthetic construct
  source 1..289: mol_type = other RNA
cgctcttccgcgtctcttaagcttgcgcggcagccatatgggccctatgcccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56057 - RNA, 289 nt, synthetic construct
  source 1..289: mol_type = other RNA
cgctcttccgcgtctcttaagcttgcgcggcagccatatgggccctatggagccctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56058 - RNA, 289 nt, synthetic construct
  source 1..289: mol_type = other RNA
cgctcttccgcgtctcttaagcttgcgcggcagccatatgggccctatggagatacccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56059 - RNA, 289 nt, synthetic construct
  source 1..289: mol_type = other RNA
cgctcttccgcgtctcttaagcttgcgcggcagccatatgggccctatggagatataccccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56060 - RNA, 289 nt, synthetic construct
  source 1..289: mol_type = other RNA
cgctcttccgcgtctcttaagcttgcgcggcagccatatgggccctatggagatatacaagcccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56061 - RNA, 289 nt, synthetic construct
  source 1..289: mol_type = other RNA
cgctcttccgcgtctcttaagcttgcgcggcagccatatgggccctatggagatatacaagacaccctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56062 - RNA, 289 nt, synthetic construct
  source 1..289: mol_type = other RNA
cgctcttccgcgtctcttaagcttgcgcggcagccatatgggccctatggagatatacaagacagtgcccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56063 - RNA, 289 nt, synthetic construct
  source 1..289: mol_type = other RNA
cgctcttccgcgtctcttaagcttgcgcggcagccatatgggccctatggagatatacaagacagtgtctccctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56064 - RNA, 289 nt, synthetic construct
  source 1..289: mol_type = other RNA
cgctcttccgcgtctcttaagcttgcgcggcagccatatgggccctatggagatatacaagacagtgtctgcacccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56065 - RNA, 289 nt, synthetic construct
  source 1..289: mol_type = other RNA
cgctcttccgcgtctcttaagcttgcgcggcagccatatgggccctatggagatatacaagacagtgtctgcatggcccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56066 - RNA, 289 nt, synthetic construct
  source 1..289: mol_type = other RNA
cgctcttccgcgtctcttaagcttgcgcggcagccatatgggccctatggagatatacaagacagtgtctgcatggaagccccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56067 - RNA, 289 nt, synthetic construct
  source 1..289: mol_type = other RNA
cgctcttccgcgtctcttaagcttgcgcggcagccatatgggccctatggagatatacaagacagtgtctgcatggaagagacccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56068 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagcccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56069 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccaccccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56070 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56071 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcggcccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56072 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtacccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56073 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgcccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56074 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagccccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56075 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctccccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56076 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttccccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56077 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagacccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56078 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaaccccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56079 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatccccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56080 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56081 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56082 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56083 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56084 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56085 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56086 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56087 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56088 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56089 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56090 - RNA, 289 nt, synthetic construct
  source 1..289: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56091 - RNA, 292 nt, synthetic construct
  source 1..292: mol_type = other RNA
cgctcttccgcgtctcttaagcttgaagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56092 - RNA, 292 nt, synthetic construct
  source 1..292: mol_type = other RNA
cgctcttccgcgtctcttaagcttgcgcaagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56093 - RNA, 292 nt, synthetic construct
  source 1..292: mol_type = other RNA
cgctcttccgcgtctcttaagcttgcgcggcaagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56094 - RNA, 292 nt, synthetic construct
  source 1..292: mol_type = other RNA
cgctcttccgcgtctcttaagcttgcgcggcagcaagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56095 - RNA, 292 nt, synthetic construct
  source 1..292: mol_type = other RNA
cgctcttccgcgtctcttaagcttgcgcggcagccataagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56096 - RNA, 292 nt, synthetic construct
  source 1..292: mol_type = other RNA
cgctcttccgcgtctcttaagcttgcgcggcagccatatgaagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56097 - RNA, 292 nt, synthetic construct
  source 1..292: mol_type = other RNA
cgctcttccgcgtctcttaagcttgcgcggcagccatatgggcaagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56098 - RNA, 292 nt, synthetic construct
  source 1..292: mol_type = other RNA
cgctcttccgcgtctcttaagcttgcgcggcagccatatgggccctaagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56099 - RNA, 292 nt, synthetic construct
  source 1..292: mol_type = other RNA
cgctcttccgcgtctcttaagcttgcgcggcagccatatgggccctatgaaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56100 - RNA, 292 nt, synthetic construct
  source 1..292: mol_type = other RNA
cgctcttccgcgtctcttaagcttgcgcggcagccatatgggccctatggagaagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56101 - RNA, 292 nt, synthetic construct
  source 1..292: mol_type = other RNA
cgctcttccgcgtctcttaagcttgcgcggcagccatatgggccctatggagataaagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56102 - RNA, 292 nt, synthetic construct
  source 1..292: mol_type = other RNA
cgctcttccgcgtctcttaagcttgcgcggcagccatatgggccctatggagatatacaagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56103 - RNA, 292 nt, synthetic construct; identical to SEQ ID NO: 56102
  source 1..292: mol_type = other RNA

SEQ ID NO: 56104 - RNA, 292 nt, synthetic construct
  source 1..292: mol_type = other RNA
cgctcttccgcgtctcttaagcttgcgcggcagccatatgggccctatggagatatacaagacaaaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56105 - RNA, 292 nt, synthetic construct
  source 1..292: mol_type = other RNA
cgctcttccgcgtctcttaagcttgcgcggcagccatatgggccctatggagatatacaagacagtgaagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56106 - RNA, 292 nt, synthetic construct
  source 1..292: mol_type = other RNA
cgctcttccgcgtctcttaagcttgcgcggcagccatatgggccctatggagatatacaagacagtgtctaaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56107 - RNA, 292 nt, synthetic construct
  source 1..292: mol_type = other RNA
cgctcttccgcgtctcttaagcttgcgcggcagccatatgggccctatggagatatacaagacagtgtctgcaaagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56108 - RNA, 292 nt, synthetic construct
  source 1..292: mol_type = other RNA
cgctcttccgcgtctcttaagcttgcgcggcagccatatgggccctatggagatatacaagacagtgtctgcatggaagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56109 - RNA, 292 nt, synthetic construct; identical to SEQ ID NO: 56108
  source 1..292: mol_type = other RNA

SEQ ID NO: 56110 - RNA, 292 nt, synthetic construct
  source 1..292: mol_type = other RNA
cgctcttccgcgtctcttaagcttgcgcggcagccatatgggccctatggagatatacaagacagtgtctgcatggaagagaaagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56111 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagaagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56112 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaaaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56113 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgaagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56114 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggaaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56115 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaaagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56116 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgaagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56117 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcaagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56118 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcaagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56119 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcaagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56120 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56121 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacaagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56122 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcaaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56123 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56124 - RNA, 292 nt, synthetic construct; identical to SEQ ID NO: 56123
  source 1..292: mol_type = other RNA

SEQ ID NO: 56125 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56126 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56127 - RNA, 292 nt, synthetic construct; identical to SEQ ID NO: 56126
  source 1..292: mol_type = other RNA

SEQ ID NO: 56128 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56129 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56130 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56131 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56132 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56133 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56134 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcaagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56135 - RNA, 292 nt, synthetic construct
  source 1..292: mol_type = other RNA
cgctcttccgcgtctcttaagcttgaaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56136 - RNA, 292 nt, synthetic construct
  source 1..292: mol_type = other RNA
cgctcttccgcgtctcttaagcttgcgcaacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56137 - RNA, 292 nt, synthetic construct
  source 1..292: mol_type = other RNA
cgctcttccgcgtctcttaagcttgcgcggcaacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56138 - RNA, 292 nt, synthetic construct
  source 1..292: mol_type = other RNA
cgctcttccgcgtctcttaagcttgcgcggcagcaaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56139 - RNA, 292 nt, synthetic construct
  source 1..292: mol_type = other RNA
cgctcttccgcgtctcttaagcttgcgcggcagccataacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56140 - RNA, 292 nt, synthetic construct
  source 1..292: mol_type = other RNA
cgctcttccgcgtctcttaagcttgcgcggcagccatatgaacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56141 - RNA, 292 nt, synthetic construct
  source 1..292: mol_type = other RNA
cgctcttccgcgtctcttaagcttgcgcggcagccatatgggcaaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56142 - RNA, 292 nt, synthetic construct
  source 1..292: mol_type = other RNA
cgctcttccgcgtctcttaagcttgcgcggcagccatatgggccctaacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56143 - RNA, 292 nt, synthetic construct
  source 1..292: mol_type = other RNA
cgctcttccgcgtctcttaagcttgcgcggcagccatatgggccctatgaacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56144 - RNA, 292 nt, synthetic construct
  source 1..292: mol_type = other RNA
cgctcttccgcgtctcttaagcttgcgcggcagccatatgggccctatggagaacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56145 - RNA, 292 nt, synthetic construct
  source 1..292: mol_type = other RNA
cgctcttccgcgtctcttaagcttgcgcggcagccatatgggccctatggagataaactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56146 - RNA, 292 nt, synthetic construct
  source 1..292: mol_type = other RNA
cgctcttccgcgtctcttaagcttgcgcggcagccatatgggccctatggagatatacaacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56147 - RNA, 292 nt, synthetic construct
  source 1..292: mol_type = other RNA
cgctcttccgcgtctcttaagcttgcgcggcagccatatgggccctatggagatatacaagaacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56148 - RNA, 292 nt, synthetic construct
  source 1..292: mol_type = other RNA
cgctcttccgcgtctcttaagcttgcgcggcagccatatgggccctatggagatatacaagacaaacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56149 - RNA, 292 nt, synthetic construct
  source 1..292: mol_type = other RNA
cgctcttccgcgtctcttaagcttgcgcggcagccatatgggccctatggagatatacaagacagtgaactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56150 - RNA, 292 nt, synthetic construct
  source 1..292: mol_type = other RNA
cgctcttccgcgtctcttaagcttgcgcggcagccatatgggccctatggagatatacaagacagtgtctaacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56151 - RNA, 292 nt, synthetic construct
  source 1..292: mol_type = other RNA
cgctcttccgcgtctcttaagcttgcgcggcagccatatgggccctatggagatatacaagacagtgtctgcaaactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56152 - RNA, 292 nt, synthetic construct
  source 1..292: mol_type = other RNA
cgctcttccgcgtctcttaagcttgcgcggcagccatatgggccctatggagatatacaagacagtgtctgcatggaacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56153 - RNA, 292 nt, synthetic construct
  source 1..292: mol_type = other RNA
cgctcttccgcgtctcttaagcttgcgcggcagccatatgggccctatggagatatacaagacagtgtctgcatggaagaacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56154 - RNA, 292 nt, synthetic construct
  source 1..292: mol_type = other RNA
cgctcttccgcgtctcttaagcttgcgcggcagccatatgggccctatggagatatacaagacagtgtctgcatggaagagaaaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56155 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagaacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56156 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaaacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56157 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgaaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56158 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggaacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56159 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaaacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56160 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgaacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56161 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcaacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56162 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcaacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56163 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcaacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56164 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56165 - RNA, 292 nt, synthetic construct; identical to SEQ ID NO: 56164
  source 1..292: mol_type = other RNA

SEQ ID NO: 56166 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcaacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56167 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56168 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56169 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56170 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56171 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56172 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56173 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56174 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56175 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56176 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56177 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56178 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcaacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56179 - RNA, 292 nt, synthetic construct
  source 1..292: mol_type = other RNA
cgctcttccgcgtctcttaagcttgatgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56180 - RNA, 292 nt, synthetic construct
  source 1..292: mol_type = other RNA
cgctcttccgcgtctcttaagcttgcgcatgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56181 - RNA, 292 nt, synthetic construct
  source 1..292: mol_type = other RNA
cgctcttccgcgtctcttaagcttgcgcggcatgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56182 - RNA, 292 nt, synthetic construct
  source 1..292: mol_type = other RNA
cgctcttccgcgtctcttaagcttgcgcggcagcatgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56183 - RNA, 292 nt, synthetic construct
  source 1..292: mol_type = other RNA
cgctcttccgcgtctcttaagcttgcgcggcagccatatgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56184 - RNA, 292 nt, synthetic construct; identical to SEQ ID NO: 56183
  source 1..292: mol_type = other RNA

SEQ ID NO: 56185 - RNA, 292 nt, synthetic construct
  source 1..292: mol_type = other RNA
cgctcttccgcgtctcttaagcttgcgcggcagccatatgggcatgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56186 - RNA, 292 nt, synthetic construct
  source 1..292: mol_type = other RNA
cgctcttccgcgtctcttaagcttgcgcggcagccatatgggccctatgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56187 - RNA, 292 nt, synthetic construct; identical to SEQ ID NO: 56186
  source 1..292: mol_type = other RNA

SEQ ID NO: 56188 - RNA, 292 nt, synthetic construct
  source 1..292: mol_type = other RNA
cgctcttccgcgtctcttaagcttgcgcggcagccatatgggccctatggagatgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56189 - RNA, 292 nt, synthetic construct
  source 1..292: mol_type = other RNA
cgctcttccgcgtctcttaagcttgcgcggcagccatatgggccctatggagataatgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56190 - RNA, 292 nt, synthetic construct
  source 1..292: mol_type = other RNA
cgctcttccgcgtctcttaagcttgcgcggcagccatatgggccctatggagatatacatgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56191 - RNA, 292 nt, synthetic construct
  source 1..292: mol_type = other RNA
cgctcttccgcgtctcttaagcttgcgcggcagccatatgggccctatggagatatacaagatgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56192 - RNA, 292 nt, synthetic construct
  source 1..292: mol_type = other RNA
cgctcttccgcgtctcttaagcttgcgcggcagccatatgggccctatggagatatacaagacaatggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56193 - RNA, 292 nt, synthetic construct
  source 1..292: mol_type = other RNA
cgctcttccgcgtctcttaagcttgcgcggcagccatatgggccctatggagatatacaagacagtgatgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56194 - RNA, 292 nt, synthetic construct
  source 1..292: mol_type = other RNA
cgctcttccgcgtctcttaagcttgcgcggcagccatatgggccctatggagatatacaagacagtgtctatggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56195 - RNA, 292 nt, synthetic construct
  source 1..292: mol_type = other RNA
cgctcttccgcgtctcttaagcttgcgcggcagccatatgggccctatggagatatacaagacagtgtctgcaatgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56196 - RNA, 292 nt, synthetic construct
  source 1..292: mol_type = other RNA
cgctcttccgcgtctcttaagcttgcgcggcagccatatgggccctatggagatatacaagacagtgtctgcatggatgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56197 - RNA, 292 nt, synthetic construct
  source 1..292: mol_type = other RNA
cgctcttccgcgtctcttaagcttgcgcggcagccatatgggccctatggagatatacaagacagtgtctgcatggaagatgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56198 - RNA, 292 nt, synthetic construct
  source 1..292: mol_type = other RNA
cgctcttccgcgtctcttaagcttgcgcggcagccatatgggccctatggagatatacaagacagtgtctgcatggaagagaatgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56199 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagatgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56200 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaatggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56201 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgatgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56202 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggatggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56203 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaatgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56204 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgatgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56205 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcatgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56206 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcatgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56207 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcatgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56208 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaatgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56209 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56210 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcatggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56211 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacatgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56212 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagatggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56213 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaatgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56214 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaatgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56215 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagatgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56216 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtatgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56217 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgatgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56218 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcatgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56219 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcatgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56220 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgatggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56221 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaatgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56222 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcatgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56223 - RNA, 292 nt, synthetic construct
  source 1..292: mol_type = other RNA
cgctcttccgcgtctcttaagcttgatccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56224 - RNA, 292 nt, synthetic construct
  source 1..292: mol_type = other RNA
cgctcttccgcgtctcttaagcttgcgcatcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56225 - RNA, 292 nt, synthetic construct
  source 1..292: mol_type = other RNA
cgctcttccgcgtctcttaagcttgcgcggcatcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56226 - RNA, 292 nt, synthetic construct
  source 1..292: mol_type = other RNA
cgctcttccgcgtctcttaagcttgcgcggcagcatccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56227 - RNA, 292 nt, synthetic construct
  source 1..292: mol_type = other RNA
cgctcttccgcgtctcttaagcttgcgcggcagccatatcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56228 - RNA, 292 nt, synthetic construct
  source 1..292: mol_type = other RNA
cgctcttccgcgtctcttaagcttgcgcggcagccatatgatcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56229 - RNA, 292 nt, synthetic construct
  source 1..292: mol_type = other RNA
cgctcttccgcgtctcttaagcttgcgcggcagccatatgggcatccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56230 - RNA, 292 nt, synthetic construct
  source 1..292: mol_type = other RNA
cgctcttccgcgtctcttaagcttgcgcggcagccatatgggccctatcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56231 - RNA, 292 nt, synthetic construct
  source 1..292: mol_type = other RNA
cgctcttccgcgtctcttaagcttgcgcggcagccatatgggccctatgatcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56232 - RNA, 292 nt, synthetic construct
  source 1..292: mol_type = other RNA
cgctcttccgcgtctcttaagcttgcgcggcagccatatgggccctatggagatcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56233 - RNA, 292 nt, synthetic construct
  source 1..292: mol_type = other RNA
cgctcttccgcgtctcttaagcttgcgcggcagccatatgggccctatggagataatctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56234 - RNA, 292 nt, synthetic construct
  source 1..292: mol_type = other RNA
cgctcttccgcgtctcttaagcttgcgcggcagccatatgggccctatggagatatacatcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56235 - RNA, 292 nt, synthetic construct
  source 1..292: mol_type = other RNA
cgctcttccgcgtctcttaagcttgcgcggcagccatatgggccctatggagatatacaagatcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56236 - RNA, 292 nt, synthetic construct
  source 1..292: mol_type = other RNA
cgctcttccgcgtctcttaagcttgcgcggcagccatatgggccctatggagatatacaagacaatcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56237 - RNA, 292 nt, synthetic construct
  source 1..292: mol_type = other RNA
cgctcttccgcgtctcttaagcttgcgcggcagccatatgggccctatggagatatacaagacagtgatctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56238 - RNA, 292 nt, synthetic construct
  source 1..292: mol_type = other RNA
cgctcttccgcgtctcttaagcttgcgcggcagccatatgggccctatggagatatacaagacagtgtctatcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56239 - RNA, 292 nt, synthetic construct
  source 1..292: mol_type = other RNA
cgctcttccgcgtctcttaagcttgcgcggcagccatatgggccctatggagatatacaagacagtgtctgcaatctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56240 - RNA, 292 nt, synthetic construct
  source 1..292: mol_type = other RNA
cgctcttccgcgtctcttaagcttgcgcggcagccatatgggccctatggagatatacaagacagtgtctgcatggatcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56241 - RNA, 292 nt, synthetic construct
  source 1..292: mol_type = other RNA
cgctcttccgcgtctcttaagcttgcgcggcagccatatgggccctatggagatatacaagacagtgtctgcatggaagatcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56242 - RNA, 292 nt, synthetic construct
  source 1..292: mol_type = other RNA
cgctcttccgcgtctcttaagcttgcgcggcagccatatgggccctatggagatatacaagacagtgtctgcatggaagagaatccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56243 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagatcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56244 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaatcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56245 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgatccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56246 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggatcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56247 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaatcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56248 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgatcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56249 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcatcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56250 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcatcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56251 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcatcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56252 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaatcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56253 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56254 - RNA, 292 nt, synthetic construct; identical to SEQ ID NO: 56253
  source 1..292: mol_type = other RNA

SEQ ID NO: 56255 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacatcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56256 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagatcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56257 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaatcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56258 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaatcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56259 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagatcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56260 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtatcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56261 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgatcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56262 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcatcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56263 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcatcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56264 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgatcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56265 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaatcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56266 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcatcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56267 - RNA, 292 nt, synthetic construct
  source 1..292: mol_type = other RNA
cgctcttccgcgtctcttaagcttgaggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56268 - RNA, 292 nt, synthetic construct
  source 1..292: mol_type = other RNA
cgctcttccgcgtctcttaagcttgcgcaggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56269 - RNA, 292 nt, synthetic construct
  source 1..292: mol_type = other RNA
cgctcttccgcgtctcttaagcttgcgcggcaggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56270 - RNA, 292 nt, synthetic construct
  source 1..292: mol_type = other RNA
cgctcttccgcgtctcttaagcttgcgcggcagcaggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56271 - RNA, 292 nt, synthetic construct
  source 1..292: mol_type = other RNA
cgctcttccgcgtctcttaagcttgcgcggcagccataggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56272 - RNA, 292 nt, synthetic construct
  source 1..292: mol_type = other RNA
cgctcttccgcgtctcttaagcttgcgcggcagccatatgaggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56273 - RNA, 292 nt, synthetic construct
  source 1..292: mol_type = other RNA
cgctcttccgcgtctcttaagcttgcgcggcagccatatgggcaggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56274 - RNA, 292 nt, synthetic construct
  source 1..292: mol_type = other RNA
cgctcttccgcgtctcttaagcttgcgcggcagccatatgggccctaggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56275 - RNA, 292 nt, synthetic construct
  source 1..292: mol_type = other RNA
cgctcttccgcgtctcttaagcttgcgcggcagccatatgggccctatgagggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56276 - RNA, 292 nt, synthetic construct
  source 1..292: mol_type = other RNA
cgctcttccgcgtctcttaagcttgcgcggcagccatatgggccctatggagaggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56277 - RNA, 292 nt, synthetic construct
  source 1..292: mol_type = other RNA
cgctcttccgcgtctcttaagcttgcgcggcagccatatgggccctatggagataaggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56278 - RNA, 292 nt, synthetic construct
  source 1..292: mol_type = other RNA
cgctcttccgcgtctcttaagcttgcgcggcagccatatgggccctatggagatatacaggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56279 - RNA, 292 nt, synthetic construct
  source 1..292: mol_type = other RNA
cgctcttccgcgtctcttaagcttgcgcggcagccatatgggccctatggagatatacaagaggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56280 - RNA, 292 nt, synthetic construct
  source 1..292: mol_type = other RNA
cgctcttccgcgtctcttaagcttgcgcggcagccatatgggccctatggagatatacaagacaagggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56281 - RNA, 292 nt, synthetic construct
  source 1..292: mol_type = other RNA
cgctcttccgcgtctcttaagcttgcgcggcagccatatgggccctatggagatatacaagacagtgaggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56282 - RNA, 292 nt, synthetic construct
  source 1..292: mol_type = other RNA
cgctcttccgcgtctcttaagcttgcgcggcagccatatgggccctatggagatatacaagacagtgtctagggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56283 - RNA, 292 nt, synthetic construct
  source 1..292: mol_type = other RNA
cgctcttccgcgtctcttaagcttgcgcggcagccatatgggccctatggagatatacaagacagtgtctgcaaggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56284 - RNA, 292 nt, synthetic construct
  source 1..292: mol_type = other RNA
cgctcttccgcgtctcttaagcttgcgcggcagccatatgggccctatggagatatacaagacagtgtctgcatggaggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56285 - RNA, 292 nt, synthetic construct
  source 1..292: mol_type = other RNA
cgctcttccgcgtctcttaagcttgcgcggcagccatatgggccctatggagatatacaagacagtgtctgcatggaagaggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56286 - RNA, 292 nt, synthetic construct
  source 1..292: mol_type = other RNA
cgctcttccgcgtctcttaagcttgcgcggcagccatatgggccctatggagatatacaagacagtgtctgcatggaagagaaggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56287 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagaggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56288 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaagggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56289 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgaggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56290 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggagggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56291 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaaggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56292 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgaggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56293 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcaggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56294 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcaggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56295 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcaggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56296 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56297 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacaggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56298 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcagggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56299 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56300 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagagggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56301 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56302 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56303 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56304 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56305 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56306 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56307 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56308 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgagggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56309 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56310 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcaggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56311 - RNA, 292 nt, synthetic construct
  source 1..292: mol_type = other RNA
cgctcttccgcgtctcttaagcttgagccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56312 - RNA, 292 nt, synthetic construct
  source 1..292: mol_type = other RNA
cgctcttccgcgtctcttaagcttgcgcagcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56313 - RNA, 292 nt, synthetic construct
  source 1..292: mol_type = other RNA
cgctcttccgcgtctcttaagcttgcgcggcagcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56314 - RNA, 292 nt, synthetic construct; identical to SEQ ID NO: 56313
  source 1..292: mol_type = other RNA

SEQ ID NO: 56315 - RNA, 292 nt, synthetic construct
  source 1..292: mol_type = other RNA
cgctcttccgcgtctcttaagcttgcgcggcagccatagcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56316 - RNA, 292 nt, synthetic construct
  source 1..292: mol_type = other RNA
cgctcttccgcgtctcttaagcttgcgcggcagccatatgagcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56317 - RNA, 292 nt, synthetic construct
  source 1..292: mol_type = other RNA
cgctcttccgcgtctcttaagcttgcgcggcagccatatgggcagccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56318 - RNA, 292 nt, synthetic construct
  source 1..292: mol_type = other RNA
cgctcttccgcgtctcttaagcttgcgcggcagccatatgggccctagcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56319 - RNA, 292 nt, synthetic construct
  source 1..292: mol_type = other RNA
cgctcttccgcgtctcttaagcttgcgcggcagccatatgggccctatgagcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56320 - RNA, 292 nt, synthetic construct
  source 1..292: mol_type = other RNA
cgctcttccgcgtctcttaagcttgcgcggcagccatatgggccctatggagagcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56321 - RNA, 292 nt, synthetic construct
  source 1..292: mol_type = other RNA
cgctcttccgcgtctcttaagcttgcgcggcagccatatgggccctatggagataagctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56322 - RNA, 292 nt, synthetic construct
  source 1..292: mol_type = other RNA
cgctcttccgcgtctcttaagcttgcgcggcagccatatgggccctatggagatatacagcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56323 - RNA, 292 nt, synthetic construct
  source 1..292: mol_type = other RNA
cgctcttccgcgtctcttaagcttgcgcggcagccatatgggccctatggagatatacaagagcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56324 - RNA, 292 nt, synthetic construct
  source 1..292: mol_type = other RNA
cgctcttccgcgtctcttaagcttgcgcggcagccatatgggccctatggagatatacaagacaagcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56325 - RNA, 292 nt, synthetic construct
  source 1..292: mol_type = other RNA
cgctcttccgcgtctcttaagcttgcgcggcagccatatgggccctatggagatatacaagacagtgagctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56326 - RNA, 292 nt, synthetic construct
  source 1..292: mol_type = other RNA
cgctcttccgcgtctcttaagcttgcgcggcagccatatgggccctatggagatatacaagacagtgtctagcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56327 - RNA, 292 nt, synthetic construct
  source 1..292: mol_type = other RNA
cgctcttccgcgtctcttaagcttgcgcggcagccatatgggccctatggagatatacaagacagtgtctgcaagctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56328 - RNA, 292 nt, synthetic construct
  source 1..292: mol_type = other RNA
cgctcttccgcgtctcttaagcttgcgcggcagccatatgggccctatggagatatacaagacagtgtctgcatggagcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56329 - RNA, 292 nt, synthetic construct
  source 1..292: mol_type = other RNA
cgctcttccgcgtctcttaagcttgcgcggcagccatatgggccctatggagatatacaagacagtgtctgcatggaagagcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56330 - RNA, 292 nt, synthetic construct
  source 1..292: mol_type = other RNA
cgctcttccgcgtctcttaagcttgcgcggcagccatatgggccctatggagatatacaagacagtgtctgcatggaagagaagccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56331 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagagcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56332 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaagcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56333 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgagccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56334 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggagcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56335 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaagcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56336 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56337 - RNA, 292 nt, synthetic construct; identical to SEQ ID NO: 56336
  source 1..292: mol_type = other RNA

SEQ ID NO: 56338 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcagcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56339 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56340 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaagcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56341 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacagcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56342 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcagcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56343 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacagcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56344 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagagcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56345 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaagcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56346 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaagcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56347 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56348 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtagcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56349 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgagcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56350 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcagcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56351 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcagcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56352 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgagcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56353 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56354 - RNA, 292 nt, synthetic construct; identical to SEQ ID NO: 56353
  source 1..292: mol_type = other RNA

SEQ ID NO: 56355 - RNA, 292 nt, synthetic construct
  source 1..292: mol_type = other RNA
cgctcttccgcgtctcttaagcttgacgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56356 - RNA, 292 nt, synthetic construct
  source 1..292: mol_type = other RNA
cgctcttccgcgtctcttaagcttgcgcacgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56357 - RNA, 292 nt, synthetic construct
  source 1..292: mol_type = other RNA
cgctcttccgcgtctcttaagcttgcgcggcacgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56358 - RNA, 292 nt, synthetic construct
  source 1..292: mol_type = other RNA
cgctcttccgcgtctcttaagcttgcgcggcagcacgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56359 - RNA, 292 nt, synthetic construct
  source 1..292: mol_type = other RNA
cgctcttccgcgtctcttaagcttgcgcggcagccatacgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56360 - RNA, 292 nt, synthetic construct
  source 1..292: mol_type = other RNA
cgctcttccgcgtctcttaagcttgcgcggcagccatatgacgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56361 - RNA, 292 nt, synthetic construct
  source 1..292: mol_type = other RNA
cgctcttccgcgtctcttaagcttgcgcggcagccatatgggcacgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56362 - RNA, 292 nt, synthetic construct
  source 1..292: mol_type = other RNA
cgctcttccgcgtctcttaagcttgcgcggcagccatatgggccctacgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56363 - RNA, 292 nt, synthetic construct
  source 1..292: mol_type = other RNA
cgctcttccgcgtctcttaagcttgcgcggcagccatatgggccctatgacggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56364 - RNA, 292 nt, synthetic construct
  source 1..292: mol_type = other RNA
cgctcttccgcgtctcttaagcttgcgcggcagccatatgggccctatggagacgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56365 - RNA, 292 nt, synthetic construct
  source 1..292: mol_type = other RNA
cgctcttccgcgtctcttaagcttgcgcggcagccatatgggccctatggagataacgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56366 - RNA, 292 nt, synthetic construct
  source 1..292: mol_type = other RNA
cgctcttccgcgtctcttaagcttgcgcggcagccatatgggccctatggagatatacacgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56367 - RNA, 292 nt, synthetic construct
  source 1..292: mol_type = other RNA
cgctcttccgcgtctcttaagcttgcgcggcagccatatgggccctatggagatatacaagacgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56368 - RNA, 292 nt, synthetic construct
  source 1..292: mol_type = other RNA
cgctcttccgcgtctcttaagcttgcgcggcagccatatgggccctatggagatatacaagacaacggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56369 - RNA, 292 nt, synthetic construct
  source 1..292: mol_type = other RNA
cgctcttccgcgtctcttaagcttgcgcggcagccatatgggccctatggagatatacaagacagtgacgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56370 - RNA, 292 nt, synthetic construct
  source 1..292: mol_type = other RNA
cgctcttccgcgtctcttaagcttgcgcggcagccatatgggccctatggagatatacaagacagtgtctacggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56371 - RNA, 292 nt, synthetic construct
  source 1..292: mol_type = other RNA
cgctcttccgcgtctcttaagcttgcgcggcagccatatgggccctatggagatatacaagacagtgtctgcaacgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56372 - RNA, 292 nt, synthetic construct
  source 1..292: mol_type = other RNA
cgctcttccgcgtctcttaagcttgcgcggcagccatatgggccctatggagatatacaagacagtgtctgcatggacgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56373 - RNA, 292 nt, synthetic construct
  source 1..292: mol_type = other RNA
cgctcttccgcgtctcttaagcttgcgcggcagccatatgggccctatggagatatacaagacagtgtctgcatggaagacgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56374 - RNA, 292 nt, synthetic construct
  source 1..292: mol_type = other RNA
cgctcttccgcgtctcttaagcttgcgcggcagccatatgggccctatggagatatacaagacagtgtctgcatggaagagaacgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56375 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagacgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56376 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaacggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56377 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgacgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56378 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggacggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56379 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaacgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56380 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgacgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56381 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcacgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56382 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcacgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56383 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcacgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56384 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaacgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56385 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacacgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56386 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcacggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56387 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacacgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56388 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagacggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56389 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaacgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56390 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaacgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56391 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagacgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56392 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtacgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56393 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgacgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56394 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcacgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56395 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcacgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56396 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgacggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56397 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaacgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56398 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcacgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56399 - RNA, 292 nt, synthetic construct
  source 1..292: mol_type = other RNA
cgctcttccgcgtctcttaagcttgacccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56400 - RNA, 292 nt, synthetic construct
  source 1..292: mol_type = other RNA
cgctcttccgcgtctcttaagcttgcgcaccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56401 - RNA, 292 nt, synthetic construct
  source 1..292: mol_type = other RNA
cgctcttccgcgtctcttaagcttgcgcggcaccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56402 - RNA, 292 nt, synthetic construct
  source 1..292: mol_type = other RNA
cgctcttccgcgtctcttaagcttgcgcggcagcacccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56403 - RNA, 292 nt, synthetic construct
  source 1..292: mol_type = other RNA
cgctcttccgcgtctcttaagcttgcgcggcagccataccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56404 - RNA, 292 nt, synthetic construct
  source 1..292: mol_type = other RNA
cgctcttccgcgtctcttaagcttgcgcggcagccatatgaccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56405 - RNA, 292 nt, synthetic construct
  source 1..292: mol_type = other RNA
cgctcttccgcgtctcttaagcttgcgcggcagccatatgggcacccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56406 - RNA, 292 nt, synthetic construct
  source 1..292: mol_type = other RNA
cgctcttccgcgtctcttaagcttgcgcggcagccatatgggccctaccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56407 - RNA, 292 nt, synthetic construct
  source 1..292: mol_type = other RNA
cgctcttccgcgtctcttaagcttgcgcggcagccatatgggccctatgaccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56408 - RNA, 292 nt, synthetic construct
  source 1..292: mol_type = other RNA
cgctcttccgcgtctcttaagcttgcgcggcagccatatgggccctatggagaccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56409 - RNA, 292 nt, synthetic construct
  source 1..292: mol_type = other RNA
cgctcttccgcgtctcttaagcttgcgcggcagccatatgggccctatggagataacctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56410 - RNA, 292 nt, synthetic construct
  source 1..292: mol_type = other RNA
cgctcttccgcgtctcttaagcttgcgcggcagccatatgggccctatggagatatacaccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56411 - RNA, 292 nt, synthetic construct
  source 1..292: mol_type = other RNA
cgctcttccgcgtctcttaagcttgcgcggcagccatatgggccctatggagatatacaagaccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56412 - RNA, 292 nt, synthetic construct
  source 1..292: mol_type = other RNA
cgctcttccgcgtctcttaagcttgcgcggcagccatatgggccctatggagatatacaagacaaccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56413 - RNA, 292 nt, synthetic construct
  source 1..292: mol_type = other RNA
cgctcttccgcgtctcttaagcttgcgcggcagccatatgggccctatggagatatacaagacagtgacctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56414 - RNA, 292 nt, synthetic construct
  source 1..292: mol_type = other RNA
cgctcttccgcgtctcttaagcttgcgcggcagccatatgggccctatggagatatacaagacagtgtctaccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56415 - RNA, 292 nt, synthetic construct
  source 1..292: mol_type = other RNA
cgctcttccgcgtctcttaagcttgcgcggcagccatatgggccctatggagatatacaagacagtgtctgcaacctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56416 - RNA, 292 nt, synthetic construct
  source 1..292: mol_type = other RNA
cgctcttccgcgtctcttaagcttgcgcggcagccatatgggccctatggagatatacaagacagtgtctgcatggaccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56417 - RNA, 292 nt, synthetic construct
  source 1..292: mol_type = other RNA
cgctcttccgcgtctcttaagcttgcgcggcagccatatgggccctatggagatatacaagacagtgtctgcatggaagaccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56418 - RNA, 292 nt, synthetic construct
  source 1..292: mol_type = other RNA
cgctcttccgcgtctcttaagcttgcgcggcagccatatgggccctatggagatatacaagacagtgtctgcatggaagagaacccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56419 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagaccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56420 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaaccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56421 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgacccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56422 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggaccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56423 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaaccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56424 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgaccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56425 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcaccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56426 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcaccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56427 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcaccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56428 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56429 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacaccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56430 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcaccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56431 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56432 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagaccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56433 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56434 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56435 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagaccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56436 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtaccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56437 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgaccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56438 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcaccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56439 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcaccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56440 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgaccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56441 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaaccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56442 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcaccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56443 - RNA, 292 nt, synthetic construct
  source 1..292: mol_type = other RNA
cgctcttccgcgtctcttaagcttgtagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56444 - RNA, 292 nt, synthetic construct
  source 1..292: mol_type = other RNA
cgctcttccgcgtctcttaagcttgcgctagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56445 - RNA, 292 nt, synthetic construct
  source 1..292: mol_type = other RNA
cgctcttccgcgtctcttaagcttgcgcggctagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56446 - RNA, 292 nt, synthetic construct
  source 1..292: mol_type = other RNA
cgctcttccgcgtctcttaagcttgcgcggcagctagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56447 - RNA, 292 nt, synthetic construct
  source 1..292: mol_type = other RNA
cgctcttccgcgtctcttaagcttgcgcggcagccattagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56448 - RNA, 292 nt, synthetic construct
  source 1..292: mol_type = other RNA
cgctcttccgcgtctcttaagcttgcgcggcagccatatgtagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56449 - RNA, 292 nt, synthetic construct
  source 1..292: mol_type = other RNA
cgctcttccgcgtctcttaagcttgcgcggcagccatatgggctagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56450 - RNA, 292 nt, synthetic construct
  source 1..292: mol_type = other RNA
cgctcttccgcgtctcttaagcttgcgcggcagccatatgggcccttagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56451 - RNA, 292 nt, synthetic construct
  source 1..292: mol_type = other RNA
cgctcttccgcgtctcttaagcttgcgcggcagccatatgggccctatgtaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56452 - RNA, 292 nt, synthetic construct
  source 1..292: mol_type = other RNA
cgctcttccgcgtctcttaagcttgcgcggcagccatatgggccctatggagtagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56453 - RNA, 292 nt, synthetic construct
  source 1..292: mol_type = other RNA
cgctcttccgcgtctcttaagcttgcgcggcagccatatgggccctatggagatatagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56454 - RNA, 292 nt, synthetic construct
  source 1..292: mol_type = other RNA
cgctcttccgcgtctcttaagcttgcgcggcagccatatgggccctatggagatatactagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56455 - RNA, 292 nt, synthetic construct
  source 1..292: mol_type = other RNA
cgctcttccgcgtctcttaagcttgcgcggcagccatatgggccctatggagatatacaagtagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56456 - RNA, 292 nt, synthetic construct
  source 1..292: mol_type = other RNA
cgctcttccgcgtctcttaagcttgcgcggcagccatatgggccctatggagatatacaagacataggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56457 - RNA, 292 nt, synthetic construct
  source 1..292: mol_type = other RNA
cgctcttccgcgtctcttaagcttgcgcggcagccatatgggccctatggagatatacaagacagtgtagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56458 - RNA, 292 nt, synthetic construct
  source 1..292: mol_type = other RNA
cgctcttccgcgtctcttaagcttgcgcggcagccatatgggccctatggagatatacaagacagtgtcttaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56459 - RNA, 292 nt, synthetic construct
  source 1..292: mol_type = other RNA
cgctcttccgcgtctcttaagcttgcgcggcagccatatgggccctatggagatatacaagacagtgtctgcatagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56460 - RNA, 292 nt, synthetic construct
  source 1..292: mol_type = other RNA
cgctcttccgcgtctcttaagcttgcgcggcagccatatgggccctatggagatatacaagacagtgtctgcatggtagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56461 - RNA, 292 nt, synthetic construct
  source 1..292: mol_type = other RNA
cgctcttccgcgtctcttaagcttgcgcggcagccatatgggccctatggagatatacaagacagtgtctgcatggaagtagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56462 - RNA, 292 nt, synthetic construct
  source 1..292: mol_type = other RNA
cgctcttccgcgtctcttaagcttgcgcggcagccatatgggccctatggagatatacaagacagtgtctgcatggaagagatagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56463 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56464 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccataggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56465 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56466 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56467 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56468 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56469 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56470 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56471 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56472 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56473 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56474 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56475 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56476 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56477 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56478 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56479 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56480 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56481 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56482 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56483 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56484 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56485 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56486 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56487 - RNA, 292 nt, synthetic construct
  source 1..292: mol_type = other RNA
cgctcttccgcgtctcttaagcttgtaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56488 - RNA, 292 nt, synthetic construct
  source 1..292: mol_type = other RNA
cgctcttccgcgtctcttaagcttgcgctacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56489 - RNA, 292 nt, synthetic construct
  source 1..292: mol_type = other RNA
cgctcttccgcgtctcttaagcttgcgcggctacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56490 - RNA, 292 nt, synthetic construct
  source 1..292: mol_type = other RNA
cgctcttccgcgtctcttaagcttgcgcggcagctaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56491 - RNA, 292 nt, synthetic construct
  source 1..292: mol_type = other RNA
cgctcttccgcgtctcttaagcttgcgcggcagccattacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56492 - RNA, 292 nt, synthetic construct
  source 1..292: mol_type = other RNA
cgctcttccgcgtctcttaagcttgcgcggcagccatatgtacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56493 - RNA, 292 nt, synthetic construct
  source 1..292: mol_type = other RNA
cgctcttccgcgtctcttaagcttgcgcggcagccatatgggctaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56494 - RNA, 292 nt, synthetic construct
  source 1..292: mol_type = other RNA
cgctcttccgcgtctcttaagcttgcgcggcagccatatgggcccttacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56495 - RNA, 292 nt, synthetic construct
  source 1..292: mol_type = other RNA
cgctcttccgcgtctcttaagcttgcgcggcagccatatgggccctatgtacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56496 - RNA, 292 nt, synthetic construct
  source 1..292: mol_type = other RNA
cgctcttccgcgtctcttaagcttgcgcggcagccatatgggccctatggagtacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56497 - RNA, 292 nt, synthetic construct
  source 1..292: mol_type = other RNA
cgctcttccgcgtctcttaagcttgcgcggcagccatatgggccctatggagatatactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56498 - RNA, 292 nt, synthetic construct; identical to SEQ ID NO: 56497
  source 1..292: mol_type = other RNA

SEQ ID NO: 56499 - RNA, 292 nt, synthetic construct
  source 1..292: mol_type = other RNA
cgctcttccgcgtctcttaagcttgcgcggcagccatatgggccctatggagatatacaagtacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56500 - RNA, 292 nt, synthetic construct
  source 1..292: mol_type = other RNA
cgctcttccgcgtctcttaagcttgcgcggcagccatatgggccctatggagatatacaagacatacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56501 - RNA, 292 nt, synthetic construct
  source 1..292: mol_type = other RNA
cgctcttccgcgtctcttaagcttgcgcggcagccatatgggccctatggagatatacaagacagtgtactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56502 - RNA, 292 nt, synthetic construct
  source 1..292: mol_type = other RNA
cgctcttccgcgtctcttaagcttgcgcggcagccatatgggccctatggagatatacaagacagtgtcttacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56503 - RNA, 292 nt, synthetic construct
  source 1..292: mol_type = other RNA
cgctcttccgcgtctcttaagcttgcgcggcagccatatgggccctatggagatatacaagacagtgtctgcatactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56504 - RNA, 292 nt, synthetic construct
  source 1..292: mol_type = other RNA
cgctcttccgcgtctcttaagcttgcgcggcagccatatgggccctatggagatatacaagacagtgtctgcatggtacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56505 - RNA, 292 nt, synthetic construct
  source 1..292: mol_type = other RNA
cgctcttccgcgtctcttaagcttgcgcggcagccatatgggccctatggagatatacaagacagtgtctgcatggaagtacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56506 - RNA, 292 nt, synthetic construct
  source 1..292: mol_type = other RNA
cgctcttccgcgtctcttaagcttgcgcggcagccatatgggccctatggagatatacaagacagtgtctgcatggaagagataccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56507 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56508 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccatacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56509 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56510 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56511 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56512 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56513 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56514 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56515 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56516 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56517 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56518 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56519 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56520 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56521 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56522 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56523 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56524 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56525 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56526 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56527 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56528 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56529 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56530 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56531 - RNA, 292 nt, synthetic construct
  source 1..292: mol_type = other RNA
cgctcttccgcgtctcttaagcttgttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56532 - RNA, 292 nt, synthetic construct
  source 1..292: mol_type = other RNA
cgctcttccgcgtctcttaagcttgcgcttgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56533 - RNA, 292 nt, synthetic construct
  source 1..292: mol_type = other RNA
cgctcttccgcgtctcttaagcttgcgcggcttgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56534 - RNA, 292 nt, synthetic construct
  source 1..292: mol_type = other RNA
cgctcttccgcgtctcttaagcttgcgcggcagcttgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56535 - RNA, 292 nt, synthetic construct
  source 1..292: mol_type = other RNA
cgctcttccgcgtctcttaagcttgcgcggcagccatttgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56536 - RNA, 292 nt, synthetic construct
  source 1..292: mol_type = other RNA
cgctcttccgcgtctcttaagcttgcgcggcagccatatgttgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56537 - RNA, 292 nt, synthetic construct
  source 1..292: mol_type = other RNA
cgctcttccgcgtctcttaagcttgcgcggcagccatatgggcttgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56538 - RNA, 292 nt, synthetic construct
  source 1..292: mol_type = other RNA
cgctcttccgcgtctcttaagcttgcgcggcagccatatgggccctttgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56539 - RNA, 292 nt, synthetic construct
  source 1..292: mol_type = other RNA
cgctcttccgcgtctcttaagcttgcgcggcagccatatgggccctatgttggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56540 - RNA, 292 nt, synthetic construct
  source 1..292: mol_type = other RNA
cgctcttccgcgtctcttaagcttgcgcggcagccatatgggccctatggagttgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56541 - RNA, 292 nt, synthetic construct
  source 1..292: mol_type = other RNA
cgctcttccgcgtctcttaagcttgcgcggcagccatatgggccctatggagatattgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56542 - RNA, 292 nt, synthetic construct
  source 1..292: mol_type = other RNA
cgctcttccgcgtctcttaagcttgcgcggcagccatatgggccctatggagatatacttgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56543 - RNA, 292 nt, synthetic construct
  source 1..292: mol_type = other RNA
cgctcttccgcgtctcttaagcttgcgcggcagccatatgggccctatggagatatacaagttgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56544 - RNA, 292 nt, synthetic construct
  source 1..292: mol_type = other RNA
cgctcttccgcgtctcttaagcttgcgcggcagccatatgggccctatggagatatacaagacattggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56545 - RNA, 292 nt, synthetic construct
  source 1..292: mol_type = other RNA
cgctcttccgcgtctcttaagcttgcgcggcagccatatgggccctatggagatatacaagacagtgttgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56546 - RNA, 292 nt, synthetic construct
  source 1..292: mol_type = other RNA
cgctcttccgcgtctcttaagcttgcgcggcagccatatgggccctatggagatatacaagacagtgtctttggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56547 - RNA, 292 nt, synthetic construct
  source 1..292: mol_type = other RNA
cgctcttccgcgtctcttaagcttgcgcggcagccatatgggccctatggagatatacaagacagtgtctgcattgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56548 - RNA, 292 nt, synthetic construct
  source 1..292: mol_type = other RNA
cgctcttccgcgtctcttaagcttgcgcggcagccatatgggccctatggagatatacaagacagtgtctgcatggttgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56549 - RNA, 292 nt, synthetic construct
  source 1..292: mol_type = other RNA
cgctcttccgcgtctcttaagcttgcgcggcagccatatgggccctatggagatatacaagacagtgtctgcatggaagttgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56550 - RNA, 292 nt, synthetic construct
  source 1..292: mol_type = other RNA
cgctcttccgcgtctcttaagcttgcgcggcagccatatgggccctatggagatatacaagacagtgtctgcatggaagagattgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56551 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagttgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56552 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccattggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56553 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgttgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56554 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggttggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56555 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtattgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56556 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgttgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56557 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcttgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56558 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56559 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcttgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56560 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagattgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56561 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacttgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56562 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcttggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56563 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacttgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56564 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagttggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56565 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtattgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56566 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactattgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56567 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagttgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56568 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56569 - RNA, 292 nt, synthetic construct; identical to SEQ ID NO: 56568
  source 1..292: mol_type = other RNA

SEQ ID NO: 56570 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56571 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56572 - RNA, 292 nt, synthetic construct; identical to SEQ ID NO: 56571
  source 1..292: mol_type = other RNA

SEQ ID NO: 56573 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaattgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56574 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcttgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56575 - RNA, 292 nt, synthetic construct
  source 1..292: mol_type = other RNA
cgctcttccgcgtctcttaagcttgttccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56576 - RNA, 292 nt, synthetic construct
  source 1..292: mol_type = other RNA
cgctcttccgcgtctcttaagcttgcgcttcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56577 - RNA, 292 nt, synthetic construct
  source 1..292: mol_type = other RNA
cgctcttccgcgtctcttaagcttgcgcggcttcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56578 - RNA, 292 nt, synthetic construct
  source 1..292: mol_type = other RNA
cgctcttccgcgtctcttaagcttgcgcggcagcttccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56579 - RNA, 292 nt, synthetic construct
  source 1..292: mol_type = other RNA
cgctcttccgcgtctcttaagcttgcgcggcagccatttcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56580 - RNA, 292 nt, synthetic construct
  source 1..292: mol_type = other RNA
cgctcttccgcgtctcttaagcttgcgcggcagccatatgttcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56581 - RNA, 292 nt, synthetic construct
  source 1..292: mol_type = other RNA
cgctcttccgcgtctcttaagcttgcgcggcagccatatgggcttccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56582 - RNA, 292 nt, synthetic construct
  source 1..292: mol_type = other RNA
cgctcttccgcgtctcttaagcttgcgcggcagccatatgggccctttcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56583 - RNA, 292 nt, synthetic construct
  source 1..292: mol_type = other RNA
cgctcttccgcgtctcttaagcttgcgcggcagccatatgggccctatgttcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56584 - RNA, 292 nt, synthetic construct
  source 1..292: mol_type = other RNA
cgctcttccgcgtctcttaagcttgcgcggcagccatatgggccctatggagttcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56585 - RNA, 292 nt, synthetic construct
  source 1..292: mol_type = other RNA
cgctcttccgcgtctcttaagcttgcgcggcagccatatgggccctatggagatattctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56586 - RNA, 292 nt, synthetic construct
  source 1..292: mol_type = other RNA
cgctcttccgcgtctcttaagcttgcgcggcagccatatgggccctatggagatatacttcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56587 - RNA, 292 nt, synthetic construct
  source 1..292: mol_type = other RNA
cgctcttccgcgtctcttaagcttgcgcggcagccatatgggccctatggagatatacaagttcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56588 - RNA, 292 nt, synthetic construct
  source 1..292: mol_type = other RNA
cgctcttccgcgtctcttaagcttgcgcggcagccatatgggccctatggagatatacaagacattcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56589 - RNA, 292 nt, synthetic construct
  source 1..292: mol_type = other RNA
cgctcttccgcgtctcttaagcttgcgcggcagccatatgggccctatggagatatacaagacagtgttctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56590 - RNA, 292 nt, synthetic construct
  source 1..292: mol_type = other RNA
cgctcttccgcgtctcttaagcttgcgcggcagccatatgggccctatggagatatacaagacagtgtctttcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56591 - RNA, 292 nt, synthetic construct
  source 1..292: mol_type = other RNA
cgctcttccgcgtctcttaagcttgcgcggcagccatatgggccctatggagatatacaagacagtgtctgcattctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56592 - RNA, 292 nt, synthetic construct
  source 1..292: mol_type = other RNA
cgctcttccgcgtctcttaagcttgcgcggcagccatatgggccctatggagatatacaagacagtgtctgcatggttcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56593 - RNA, 292 nt, synthetic construct
  source 1..292: mol_type = other RNA
cgctcttccgcgtctcttaagcttgcgcggcagccatatgggccctatggagatatacaagacagtgtctgcatggaagttcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56594 - RNA, 292 nt, synthetic construct
  source 1..292: mol_type = other RNA
cgctcttccgcgtctcttaagcttgcgcggcagccatatgggccctatggagatatacaagacagtgtctgcatggaagagattccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56595 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagttcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56596 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccattcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56597 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgttccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56598 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggttcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56599 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtattcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56600 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgttcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56601 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcttcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56602 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56603 - RNA, 292 nt, synthetic construct; identical to SEQ ID NO: 56602
  source 1..292: mol_type = other RNA

SEQ ID NO: 56604 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagattcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56605 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacttcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56606 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcttcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56607 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacttcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56608 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagttcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56609 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtattcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56610 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactattcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56611 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagttcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56612 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56613 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgttcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56614 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56615 - RNA, 292 nt, synthetic construct; identical to SEQ ID NO: 56614
  source 1..292: mol_type = other RNA

SEQ ID NO: 56616 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgttcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56617 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaattcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56618 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcttcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56619 - RNA, 292 nt, synthetic construct
  source 1..292: mol_type = other RNA
cgctcttccgcgtctcttaagcttgtggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56620 - RNA, 292 nt, synthetic construct
  source 1..292: mol_type = other RNA
cgctcttccgcgtctcttaagcttgcgctggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56621 - RNA, 292 nt, synthetic construct
  source 1..292: mol_type = other RNA
cgctcttccgcgtctcttaagcttgcgcggctggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56622 - RNA, 292 nt, synthetic construct
  source 1..292: mol_type = other RNA
cgctcttccgcgtctcttaagcttgcgcggcagctggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56623 - RNA, 292 nt, synthetic construct
  source 1..292: mol_type = other RNA
cgctcttccgcgtctcttaagcttgcgcggcagccattggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56624 - RNA, 292 nt, synthetic construct
  source 1..292: mol_type = other RNA
cgctcttccgcgtctcttaagcttgcgcggcagccatatgtggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56625 - RNA, 292 nt, synthetic construct
  source 1..292: mol_type = other RNA
cgctcttccgcgtctcttaagcttgcgcggcagccatatgggctggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56626 - RNA, 292 nt, synthetic construct
  source 1..292: mol_type = other RNA
cgctcttccgcgtctcttaagcttgcgcggcagccatatgggcccttggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56627 - RNA, 292 nt, synthetic construct
  source 1..292: mol_type = other RNA
cgctcttccgcgtctcttaagcttgcgcggcagccatatgggccctatgtgggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56628 - RNA, 292 nt, synthetic construct
  source 1..292: mol_type = other RNA
cgctcttccgcgtctcttaagcttgcgcggcagccatatgggccctatggagtggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56629 - RNA, 292 nt, synthetic construct
  source 1..292: mol_type = other RNA
cgctcttccgcgtctcttaagcttgcgcggcagccatatgggccctatggagatatggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56630 - RNA, 292 nt, synthetic construct
  source 1..292: mol_type = other RNA
cgctcttccgcgtctcttaagcttgcgcggcagccatatgggccctatggagatatactggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56631 - RNA, 292 nt, synthetic construct
  source 1..292: mol_type = other RNA
cgctcttccgcgtctcttaagcttgcgcggcagccatatgggccctatggagatatacaagtggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56632 - RNA, 292 nt, synthetic construct
  source 1..292: mol_type = other RNA
cgctcttccgcgtctcttaagcttgcgcggcagccatatgggccctatggagatatacaagacatgggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56633 - RNA, 292 nt, synthetic construct
  source 1..292: mol_type = other RNA
cgctcttccgcgtctcttaagcttgcgcggcagccatatgggccctatggagatatacaagacagtgtggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56634 - RNA, 292 nt, synthetic construct
  source 1..292: mol_type = other RNA
cgctcttccgcgtctcttaagcttgcgcggcagccatatgggccctatggagatatacaagacagtgtcttgggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56635 - RNA, 292 nt, synthetic construct
  source 1..292: mol_type = other RNA
cgctcttccgcgtctcttaagcttgcgcggcagccatatgggccctatggagatatacaagacagtgtctgcatggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56636 - RNA, 292 nt, synthetic construct; identical to SEQ ID NO: 56635
  source 1..292: mol_type = other RNA

SEQ ID NO: 56637 - RNA, 292 nt, synthetic construct
  source 1..292: mol_type = other RNA
cgctcttccgcgtctcttaagcttgcgcggcagccatatgggccctatggagatatacaagacagtgtctgcatggaagtggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56638 - RNA, 292 nt, synthetic construct
  source 1..292: mol_type = other RNA
cgctcttccgcgtctcttaagcttgcgcggcagccatatgggccctatggagatatacaagacagtgtctgcatggaagagatggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56639 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56640 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccatgggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56641 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56642 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56643 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56644 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56645 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56646 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56647 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56648 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56649 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56650 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctgggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56651 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56652 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtgggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56653 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56654 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56655 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56656 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56657 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56658 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56659 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56660 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtgggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56661 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56662 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56663 - RNA, 292 nt, synthetic construct
  source 1..292: mol_type = other RNA
cgctcttccgcgtctcttaagcttgtgccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56664 - RNA, 292 nt, synthetic construct
  source 1..292: mol_type = other RNA
cgctcttccgcgtctcttaagcttgcgctgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56665 - RNA, 292 nt, synthetic construct
  source 1..292: mol_type = other RNA
cgctcttccgcgtctcttaagcttgcgcggctgcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56666 - RNA, 292 nt, synthetic construct
  source 1..292: mol_type = other RNA
cgctcttccgcgtctcttaagcttgcgcggcagctgccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56667 - RNA, 292 nt, synthetic construct
  source 1..292: mol_type = other RNA
cgctcttccgcgtctcttaagcttgcgcggcagccattgcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56668 - RNA, 292 nt, synthetic construct
  source 1..292: mol_type = other RNA
cgctcttccgcgtctcttaagcttgcgcggcagccatatgtgcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56669 - RNA, 292 nt, synthetic construct
  source 1..292: mol_type = other RNA
cgctcttccgcgtctcttaagcttgcgcggcagccatatgggctgccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56670 - RNA, 292 nt, synthetic construct
  source 1..292: mol_type = other RNA
cgctcttccgcgtctcttaagcttgcgcggcagccatatgggcccttgcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56671 - RNA, 292 nt, synthetic construct
  source 1..292: mol_type = other RNA
cgctcttccgcgtctcttaagcttgcgcggcagccatatgggccctatgtgcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56672 - RNA, 292 nt, synthetic construct
  source 1..292: mol_type = other RNA
cgctcttccgcgtctcttaagcttgcgcggcagccatatgggccctatggagtgcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56673 - RNA, 292 nt, synthetic construct
  source 1..292: mol_type = other RNA
cgctcttccgcgtctcttaagcttgcgcggcagccatatgggccctatggagatatgctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56674 - RNA, 292 nt, synthetic construct
  source 1..292: mol_type = other RNA
cgctcttccgcgtctcttaagcttgcgcggcagccatatgggccctatggagatatactgcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56675 - RNA, 292 nt, synthetic construct
  source 1..292: mol_type = other RNA
cgctcttccgcgtctcttaagcttgcgcggcagccatatgggccctatggagatatacaagtgcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56676 - RNA, 292 nt, synthetic construct
  source 1..292: mol_type = other RNA
cgctcttccgcgtctcttaagcttgcgcggcagccatatgggccctatggagatatacaagacatgcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56677 - RNA, 292 nt, synthetic construct
  source 1..292: mol_type = other RNA
cgctcttccgcgtctcttaagcttgcgcggcagccatatgggccctatggagatatacaagacagtgtgctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56678 - RNA, 292 nt, synthetic construct
  source 1..292: mol_type = other RNA
cgctcttccgcgtctcttaagcttgcgcggcagccatatgggccctatggagatatacaagacagtgtcttgcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56679 - RNA, 292 nt, synthetic construct
  source 1..292: mol_type = other RNA
cgctcttccgcgtctcttaagcttgcgcggcagccatatgggccctatggagatatacaagacagtgtctgcatgctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56680 - RNA, 292 nt, synthetic construct
  source 1..292: mol_type = other RNA
cgctcttccgcgtctcttaagcttgcgcggcagccatatgggccctatggagatatacaagacagtgtctgcatggtgcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56681 - RNA, 292 nt, synthetic construct
  source 1..292: mol_type = other RNA
cgctcttccgcgtctcttaagcttgcgcggcagccatatgggccctatggagatatacaagacagtgtctgcatggaagtgcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56682 - RNA, 292 nt, synthetic construct
  source 1..292: mol_type = other RNA
cgctcttccgcgtctcttaagcttgcgcggcagccatatgggccctatggagatatacaagacagtgtctgcatggaagagatgccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56683 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtgcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56684 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccatgcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56685 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtgccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56686 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtgcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56687 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatgcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56688 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtgcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56689 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctgcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56690 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctgcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56691 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctgcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56692 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatgcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56693 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactgcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56694 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctgcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56695 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactgcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56696 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtgcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56697 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatgcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56698 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatgcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56699 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtgcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56700 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttgcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56701 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtgcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56702 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctgcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56703 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctgcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56704 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtgcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56705 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatgcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56706 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctgcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56707 - RNA, 292 nt, synthetic construct
  source 1..292: mol_type = other RNA
cgctcttccgcgtctcttaagcttgtcgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56708 - RNA, 292 nt, synthetic construct
  source 1..292: mol_type = other RNA
cgctcttccgcgtctcttaagcttgcgctcgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56709 - RNA, 292 nt, synthetic construct
  source 1..292: mol_type = other RNA
cgctcttccgcgtctcttaagcttgcgcggctcgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56710 - RNA, 292 nt, synthetic construct
  source 1..292: mol_type = other RNA
cgctcttccgcgtctcttaagcttgcgcggcagctcgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56711 - RNA, 292 nt, synthetic construct
  source 1..292: mol_type = other RNA
cgctcttccgcgtctcttaagcttgcgcggcagccattcgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56712 - RNA, 292 nt, synthetic construct
  source 1..292: mol_type = other RNA
cgctcttccgcgtctcttaagcttgcgcggcagccatatgtcgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56713 - RNA, 292 nt, synthetic construct
  source 1..292: mol_type = other RNA
cgctcttccgcgtctcttaagcttgcgcggcagccatatgggctcgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56714 - RNA, 292 nt, synthetic construct
  source 1..292: mol_type = other RNA
cgctcttccgcgtctcttaagcttgcgcggcagccatatgggcccttcgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56715 - RNA, 292 nt, synthetic construct
  source 1..292: mol_type = other RNA
cgctcttccgcgtctcttaagcttgcgcggcagccatatgggccctatgtcggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56716 - RNA, 292 nt, synthetic construct
  source 1..292: mol_type = other RNA
cgctcttccgcgtctcttaagcttgcgcggcagccatatgggccctatggagtcgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56717 - RNA, 292 nt, synthetic construct
  source 1..292: mol_type = other RNA
cgctcttccgcgtctcttaagcttgcgcggcagccatatgggccctatggagatatcgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56718 - RNA, 292 nt, synthetic construct
  source 1..292: mol_type = other RNA
cgctcttccgcgtctcttaagcttgcgcggcagccatatgggccctatggagatatactcgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56719 - RNA, 292 nt, synthetic construct
  source 1..292: mol_type = other RNA
cgctcttccgcgtctcttaagcttgcgcggcagccatatgggccctatggagatatacaagtcgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56720 - RNA, 292 nt, synthetic construct
  source 1..292: mol_type = other RNA
cgctcttccgcgtctcttaagcttgcgcggcagccatatgggccctatggagatatacaagacatcggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56721 - RNA, 292 nt, synthetic construct
  source 1..292: mol_type = other RNA
cgctcttccgcgtctcttaagcttgcgcggcagccatatgggccctatggagatatacaagacagtgtcgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56722 - RNA, 292 nt, synthetic construct
  source 1..292: mol_type = other RNA
cgctcttccgcgtctcttaagcttgcgcggcagccatatgggccctatggagatatacaagacagtgtcttcggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56723 - RNA, 292 nt, synthetic construct
  source 1..292: mol_type = other RNA
cgctcttccgcgtctcttaagcttgcgcggcagccatatgggccctatggagatatacaagacagtgtctgcatcgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56724 - RNA, 292 nt, synthetic construct
  source 1..292: mol_type = other RNA
cgctcttccgcgtctcttaagcttgcgcggcagccatatgggccctatggagatatacaagacagtgtctgcatggtcgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56725 - RNA, 292 nt, synthetic construct
  source 1..292: mol_type = other RNA
cgctcttccgcgtctcttaagcttgcgcggcagccatatgggccctatggagatatacaagacagtgtctgcatggaagtcgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56726 - RNA, 292 nt, synthetic construct
  source 1..292: mol_type = other RNA
cgctcttccgcgtctcttaagcttgcgcggcagccatatgggccctatggagatatacaagacagtgtctgcatggaagagatcgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56727 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtcgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56728 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccatcggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56729 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtcgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56730 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtcggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56731 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatcgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56732 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtcgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56733 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctcgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56734 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctcgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56735 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctcgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56736 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatcgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56737 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactcgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56738 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctcggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56739 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactcgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56740 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtcggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56741 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatcgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56742 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatcgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56743 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtcgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56744 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttcgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56745 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtcgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56746 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctcgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56747 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctcgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56748 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtcggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56749 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatcgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56750 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctcgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56751 - RNA, 292 nt, synthetic construct
  source 1..292: mol_type = other RNA
cgctcttccgcgtctcttaagcttgtcccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56752 - RNA, 292 nt, synthetic construct
  source 1..292: mol_type = other RNA
cgctcttccgcgtctcttaagcttgcgctccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56753 - RNA, 292 nt, synthetic construct
  source 1..292: mol_type = other RNA
cgctcttccgcgtctcttaagcttgcgcggctccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56754 - RNA, 292 nt, synthetic construct
  source 1..292: mol_type = other RNA
cgctcttccgcgtctcttaagcttgcgcggcagctcccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56755 - RNA, 292 nt, synthetic construct
  source 1..292: mol_type = other RNA
cgctcttccgcgtctcttaagcttgcgcggcagccattccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56756 - RNA, 292 nt, synthetic construct
  source 1..292: mol_type = other RNA
cgctcttccgcgtctcttaagcttgcgcggcagccatatgtccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56757 - RNA, 292 nt, synthetic construct
  source 1..292: mol_type = other RNA
cgctcttccgcgtctcttaagcttgcgcggcagccatatgggctcccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56758 - RNA, 292 nt, synthetic construct
  source 1..292: mol_type = other RNA
cgctcttccgcgtctcttaagcttgcgcggcagccatatgggcccttccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56759 - RNA, 292 nt, synthetic construct
  source 1..292: mol_type = other RNA
cgctcttccgcgtctcttaagcttgcgcggcagccatatgggccctatgtccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56760 - RNA, 292 nt, synthetic construct
  source 1..292: mol_type = other RNA
cgctcttccgcgtctcttaagcttgcgcggcagccatatgggccctatggagtccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56761 - RNA, 292 nt, synthetic construct
  source 1..292: mol_type = other RNA
cgctcttccgcgtctcttaagcttgcgcggcagccatatgggccctatggagatatcctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56762 - RNA, 292 nt, synthetic construct
  source 1..292: mol_type = other RNA
cgctcttccgcgtctcttaagcttgcgcggcagccatatgggccctatggagatatactccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56763 - RNA, 292 nt, synthetic construct
  source 1..292: mol_type = other RNA
cgctcttccgcgtctcttaagcttgcgcggcagccatatgggccctatggagatatacaagtccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56764 - RNA, 292 nt, synthetic construct
  source 1..292: mol_type = other RNA
cgctcttccgcgtctcttaagcttgcgcggcagccatatgggccctatggagatatacaagacatccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56765 - RNA, 292 nt, synthetic construct
  source 1..292: mol_type = other RNA
cgctcttccgcgtctcttaagcttgcgcggcagccatatgggccctatggagatatacaagacagtgtcctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56766 - RNA, 292 nt, synthetic construct
  source 1..292: mol_type = other RNA
cgctcttccgcgtctcttaagcttgcgcggcagccatatgggccctatggagatatacaagacagtgtcttccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56767 - RNA, 292 nt, synthetic construct
  source 1..292: mol_type = other RNA
cgctcttccgcgtctcttaagcttgcgcggcagccatatgggccctatggagatatacaagacagtgtctgcatcctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56768 - RNA, 292 nt, synthetic construct
  source 1..292: mol_type = other RNA
cgctcttccgcgtctcttaagcttgcgcggcagccatatgggccctatggagatatacaagacagtgtctgcatggtccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56769 - RNA, 292 nt, synthetic construct
  source 1..292: mol_type = other RNA
cgctcttccgcgtctcttaagcttgcgcggcagccatatgggccctatggagatatacaagacagtgtctgcatggaagtccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56770 - RNA, 292 nt, synthetic construct
  source 1..292: mol_type = other RNA
cgctcttccgcgtctcttaagcttgcgcggcagccatatgggccctatggagatatacaagacagtgtctgcatggaagagatcccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56771 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagtccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56772 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccatccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56773 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgtcccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56774 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggtccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56775 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtatccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56776 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgtccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56777 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagctccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56778 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctctccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56779 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttctccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56780 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagatccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56781 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaactccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56782 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatctccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56783 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgactccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56784 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagtccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56785 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtatccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56786 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactatccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56787 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagtccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56788 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagttccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56789 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgtccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56790 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggctccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56791 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttctccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56792 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgtccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56793 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaatccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56794 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagctccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56795 - RNA, 292 nt, synthetic construct
  source 1..292: mol_type = other RNA
cgctcttccgcgtctcttaagcttggagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56796 - RNA, 292 nt, synthetic construct
  source 1..292: mol_type = other RNA
cgctcttccgcgtctcttaagcttgcgcgagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56797 - RNA, 292 nt, synthetic construct
  source 1..292: mol_type = other RNA
cgctcttccgcgtctcttaagcttgcgcggcgagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56798 - RNA, 292 nt, synthetic construct
  source 1..292: mol_type = other RNA
cgctcttccgcgtctcttaagcttgcgcggcagcgagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56799 - RNA, 292 nt, synthetic construct
  source 1..292: mol_type = other RNA
cgctcttccgcgtctcttaagcttgcgcggcagccatgagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56800 - RNA, 292 nt, synthetic construct
  source 1..292: mol_type = other RNA
cgctcttccgcgtctcttaagcttgcgcggcagccatatggagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56801 - RNA, 292 nt, synthetic construct
  source 1..292: mol_type = other RNA
cgctcttccgcgtctcttaagcttgcgcggcagccatatgggcgagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56802 - RNA, 292 nt, synthetic construct
  source 1..292: mol_type = other RNA
cgctcttccgcgtctcttaagcttgcgcggcagccatatgggccctgagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56803 - RNA, 292 nt, synthetic construct
  source 1..292: mol_type = other RNA
cgctcttccgcgtctcttaagcttgcgcggcagccatatgggccctatggaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56804 - RNA, 292 nt, synthetic construct; identical to SEQ ID NO: 56803
  source 1..292: mol_type = other RNA

SEQ ID NO: 56805 - RNA, 292 nt, synthetic construct
  source 1..292: mol_type = other RNA
cgctcttccgcgtctcttaagcttgcgcggcagccatatgggccctatggagatagagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56806 - RNA, 292 nt, synthetic construct
  source 1..292: mol_type = other RNA
cgctcttccgcgtctcttaagcttgcgcggcagccatatgggccctatggagatatacgagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56807 - RNA, 292 nt, synthetic construct
  source 1..292: mol_type = other RNA
cgctcttccgcgtctcttaagcttgcgcggcagccatatgggccctatggagatatacaaggagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56808 - RNA, 292 nt, synthetic construct
  source 1..292: mol_type = other RNA
cgctcttccgcgtctcttaagcttgcgcggcagccatatgggccctatggagatatacaagacagaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56809 - RNA, 292 nt, synthetic construct
  source 1..292: mol_type = other RNA
cgctcttccgcgtctcttaagcttgcgcggcagccatatgggccctatggagatatacaagacagtggagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56810 - RNA, 292 nt, synthetic construct
  source 1..292: mol_type = other RNA
cgctcttccgcgtctcttaagcttgcgcggcagccatatgggccctatggagatatacaagacagtgtctgaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56811 - RNA, 292 nt, synthetic construct
  source 1..292: mol_type = other RNA
cgctcttccgcgtctcttaagcttgcgcggcagccatatgggccctatggagatatacaagacagtgtctgcagagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56812 - RNA, 292 nt, synthetic construct
  source 1..292: mol_type = other RNA
cgctcttccgcgtctcttaagcttgcgcggcagccatatgggccctatggagatatacaagacagtgtctgcatgggagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56813 - RNA, 292 nt, synthetic construct
  source 1..292: mol_type = other RNA
cgctcttccgcgtctcttaagcttgcgcggcagccatatgggccctatggagatatacaagacagtgtctgcatggaaggagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56814 - RNA, 292 nt, synthetic construct
  source 1..292: mol_type = other RNA
cgctcttccgcgtctcttaagcttgcgcggcagccatatgggccctatggagatatacaagacagtgtctgcatggaagagagagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56815 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56816 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56817 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56818 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56819 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56820 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56821 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56822 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56823 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56824 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56825 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56826 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56827 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56828 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56829 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56830 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56831 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56832 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56833 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56834 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56835 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56836 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56837 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56838 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56839 - RNA, 292 nt, synthetic construct
  source 1..292: mol_type = other RNA
cgctcttccgcgtctcttaagcttggaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56840 - RNA, 292 nt, synthetic construct
  source 1..292: mol_type = other RNA
cgctcttccgcgtctcttaagcttgcgcgacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56841 - RNA, 292 nt, synthetic construct
  source 1..292: mol_type = other RNA
cgctcttccgcgtctcttaagcttgcgcggcgacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56842 - RNA, 292 nt, synthetic construct
  source 1..292: mol_type = other RNA
cgctcttccgcgtctcttaagcttgcgcggcagcgaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56843 - RNA, 292 nt, synthetic construct
  source 1..292: mol_type = other RNA
cgctcttccgcgtctcttaagcttgcgcggcagccatgacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56844 - RNA, 292 nt, synthetic construct
  source 1..292: mol_type = other RNA
cgctcttccgcgtctcttaagcttgcgcggcagccatatggacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56845 - RNA, 292 nt, synthetic construct
  source 1..292: mol_type = other RNA
cgctcttccgcgtctcttaagcttgcgcggcagccatatgggcgaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56846 - RNA, 292 nt, synthetic construct
  source 1..292: mol_type = other RNA
cgctcttccgcgtctcttaagcttgcgcggcagccatatgggccctgacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56847 - RNA, 292 nt, synthetic construct
  source 1..292: mol_type = other RNA
cgctcttccgcgtctcttaagcttgcgcggcagccatatgggccctatggacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56848 - RNA, 292 nt, synthetic construct
  source 1..292: mol_type = other RNA
cgctcttccgcgtctcttaagcttgcgcggcagccatatgggccctatggaggacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56849 - RNA, 292 nt, synthetic construct
  source 1..292: mol_type = other RNA
cgctcttccgcgtctcttaagcttgcgcggcagccatatgggccctatggagatagactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56850 - RNA, 292 nt, synthetic construct
  source 1..292: mol_type = other RNA
cgctcttccgcgtctcttaagcttgcgcggcagccatatgggccctatggagatatacgacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56851 - RNA, 292 nt, synthetic construct
  source 1..292: mol_type = other RNA
cgctcttccgcgtctcttaagcttgcgcggcagccatatgggccctatggagatatacaaggacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56852 - RNA, 292 nt, synthetic construct
  source 1..292: mol_type = other RNA
cgctcttccgcgtctcttaagcttgcgcggcagccatatgggccctatggagatatacaagacagacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56853 - RNA, 292 nt, synthetic construct
  source 1..292: mol_type = other RNA
cgctcttccgcgtctcttaagcttgcgcggcagccatatgggccctatggagatatacaagacagtggactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56854 - RNA, 292 nt, synthetic construct
  source 1..292: mol_type = other RNA
cgctcttccgcgtctcttaagcttgcgcggcagccatatgggccctatggagatatacaagacagtgtctgacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56855 - RNA, 292 nt, synthetic construct
  source 1..292: mol_type = other RNA
cgctcttccgcgtctcttaagcttgcgcggcagccatatgggccctatggagatatacaagacagtgtctgcagactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56856 - RNA, 292 nt, synthetic construct
  source 1..292: mol_type = other RNA
cgctcttccgcgtctcttaagcttgcgcggcagccatatgggccctatggagatatacaagacagtgtctgcatgggacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56857 - RNA, 292 nt, synthetic construct
  source 1..292: mol_type = other RNA
cgctcttccgcgtctcttaagcttgcgcggcagccatatgggccctatggagatatacaagacagtgtctgcatggaaggacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56858 - RNA, 292 nt, synthetic construct
  source 1..292: mol_type = other RNA
cgctcttccgcgtctcttaagcttgcgcggcagccatatgggccctatggagatatacaagacagtgtctgcatggaagagagaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56859 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56860 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56861 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56862 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56863 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56864 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56865 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56866 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56867 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56868 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56869 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56870 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56871 - RNA, 292 nt, synthetic construct; identical to SEQ ID NO: 56870
  source 1..292: mol_type = other RNA

SEQ ID NO: 56872 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56873 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56874 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56875 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56876 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56877 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56878 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56879 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56880 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56881 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56882 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56883 - RNA, 292 nt, synthetic construct
  source 1..292: mol_type = other RNA
cgctcttccgcgtctcttaagcttggtgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56884 - RNA, 292 nt, synthetic construct
  source 1..292: mol_type = other RNA
cgctcttccgcgtctcttaagcttgcgcgtgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56885 - RNA, 292 nt, synthetic construct
  source 1..292: mol_type = other RNA
cgctcttccgcgtctcttaagcttgcgcggcgtgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56886 - RNA, 292 nt, synthetic construct
  source 1..292: mol_type = other RNA
cgctcttccgcgtctcttaagcttgcgcggcagcgtgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56887 - RNA, 292 nt, synthetic construct
  source 1..292: mol_type = other RNA
cgctcttccgcgtctcttaagcttgcgcggcagccatgtgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56888 - RNA, 292 nt, synthetic construct
  source 1..292: mol_type = other RNA
cgctcttccgcgtctcttaagcttgcgcggcagccatatggtgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56889 - RNA, 292 nt, synthetic construct
  source 1..292: mol_type = other RNA
cgctcttccgcgtctcttaagcttgcgcggcagccatatgggcgtgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56890 - RNA, 292 nt, synthetic construct
  source 1..292: mol_type = other RNA
cgctcttccgcgtctcttaagcttgcgcggcagccatatgggccctgtgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56891 - RNA, 292 nt, synthetic construct
  source 1..292: mol_type = other RNA
cgctcttccgcgtctcttaagcttgcgcggcagccatatgggccctatggtggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56892 - RNA, 292 nt, synthetic construct
  source 1..292: mol_type = other RNA
cgctcttccgcgtctcttaagcttgcgcggcagccatatgggccctatggaggtgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56893 - RNA, 292 nt, synthetic construct
  source 1..292: mol_type = other RNA
cgctcttccgcgtctcttaagcttgcgcggcagccatatgggccctatggagatagtgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56894 - RNA, 292 nt, synthetic construct
  source 1..292: mol_type = other RNA
cgctcttccgcgtctcttaagcttgcgcggcagccatatgggccctatggagatatacgtgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56895 - RNA, 292 nt, synthetic construct
  source 1..292: mol_type = other RNA
cgctcttccgcgtctcttaagcttgcgcggcagccatatgggccctatggagatatacaaggtgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56896 - RNA, 292 nt, synthetic construct
  source 1..292: mol_type = other RNA
cgctcttccgcgtctcttaagcttgcgcggcagccatatgggccctatggagatatacaagacagtggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56897 - RNA, 292 nt, synthetic construct; identical to SEQ ID NO: 56896
  source 1..292: mol_type = other RNA

SEQ ID NO: 56898 - RNA, 292 nt, synthetic construct
  source 1..292: mol_type = other RNA
cgctcttccgcgtctcttaagcttgcgcggcagccatatgggccctatggagatatacaagacagtgtctgtggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56899 - RNA, 292 nt, synthetic construct
  source 1..292: mol_type = other RNA
cgctcttccgcgtctcttaagcttgcgcggcagccatatgggccctatggagatatacaagacagtgtctgcagtgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56900 - RNA, 292 nt, synthetic construct
  source 1..292: mol_type = other RNA
cgctcttccgcgtctcttaagcttgcgcggcagccatatgggccctatggagatatacaagacagtgtctgcatgggtgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56901 - RNA, 292 nt, synthetic construct
  source 1..292: mol_type = other RNA
cgctcttccgcgtctcttaagcttgcgcggcagccatatgggccctatggagatatacaagacagtgtctgcatggaaggtgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56902 - RNA, 292 nt, synthetic construct
  source 1..292: mol_type = other RNA
cgctcttccgcgtctcttaagcttgcgcggcagccatatgggccctatggagatatacaagacagtgtctgcatggaagagagtgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56903 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggtgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56904 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56905 - RNA, 292 nt, synthetic construct; identical to SEQ ID NO: 56904
  source 1..292: mol_type = other RNA

SEQ ID NO: 56906 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56907 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagtgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56908 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggtgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56909 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgtgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56910 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgtgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56911 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgtgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56912 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagtgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56913 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgtgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56914 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgtggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56915 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgtgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56916 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56917 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagtgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56918 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagtgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56919 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggtgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56920 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgtgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56921 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggtgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56922 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgtgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56923 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgtgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56924 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggtggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56925 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagtgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56926 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgtgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56927 - RNA, 292 nt, synthetic construct
  source 1..292: mol_type = other RNA
cgctcttccgcgtctcttaagcttggtccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56928 - RNA, 292 nt, synthetic construct
  source 1..292: mol_type = other RNA
cgctcttccgcgtctcttaagcttgcgcgtcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56929 - RNA, 292 nt, synthetic construct
  source 1..292: mol_type = other RNA
cgctcttccgcgtctcttaagcttgcgcggcgtcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56930 - RNA, 292 nt, synthetic construct
  source 1..292: mol_type = other RNA
cgctcttccgcgtctcttaagcttgcgcggcagcgtccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56931 - RNA, 292 nt, synthetic construct
  source 1..292: mol_type = other RNA
cgctcttccgcgtctcttaagcttgcgcggcagccatgtcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56932 - RNA, 292 nt, synthetic construct
  source 1..292: mol_type = other RNA
cgctcttccgcgtctcttaagcttgcgcggcagccatatggtcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56933 - RNA, 292 nt, synthetic construct
  source 1..292: mol_type = other RNA
cgctcttccgcgtctcttaagcttgcgcggcagccatatgggcgtccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56934 - RNA, 292 nt, synthetic construct
  source 1..292: mol_type = other RNA
cgctcttccgcgtctcttaagcttgcgcggcagccatatgggccctgtcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56935 - RNA, 292 nt, synthetic construct
  source 1..292: mol_type = other RNA
cgctcttccgcgtctcttaagcttgcgcggcagccatatgggccctatggtcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56936 - RNA, 292 nt, synthetic construct
  source 1..292: mol_type = other RNA
cgctcttccgcgtctcttaagcttgcgcggcagccatatgggccctatggaggtcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56937 - RNA, 292 nt, synthetic construct
  source 1..292: mol_type = other RNA
cgctcttccgcgtctcttaagcttgcgcggcagccatatgggccctatggagatagtctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56938 - RNA, 292 nt, synthetic construct
  source 1..292: mol_type = other RNA
cgctcttccgcgtctcttaagcttgcgcggcagccatatgggccctatggagatatacgtcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56939 - RNA, 292 nt, synthetic construct
  source 1..292: mol_type = other RNA
cgctcttccgcgtctcttaagcttgcgcggcagccatatgggccctatggagatatacaaggtcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56940 - RNA, 292 nt, synthetic construct
  source 1..292: mol_type = other RNA
cgctcttccgcgtctcttaagcttgcgcggcagccatatgggccctatggagatatacaagacagtcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56941 - RNA, 292 nt, synthetic construct
  source 1..292: mol_type = other RNA
cgctcttccgcgtctcttaagcttgcgcggcagccatatgggccctatggagatatacaagacagtggtctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56942 - RNA, 292 nt, synthetic construct
  source 1..292: mol_type = other RNA
cgctcttccgcgtctcttaagcttgcgcggcagccatatgggccctatggagatatacaagacagtgtctgtcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56943 - RNA, 292 nt, synthetic construct
  source 1..292: mol_type = other RNA
cgctcttccgcgtctcttaagcttgcgcggcagccatatgggccctatggagatatacaagacagtgtctgcagtctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56944 - RNA, 292 nt, synthetic construct
  source 1..292: mol_type = other RNA
cgctcttccgcgtctcttaagcttgcgcggcagccatatgggccctatggagatatacaagacagtgtctgcatgggtcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56945 - RNA, 292 nt, synthetic construct
  source 1..292: mol_type = other RNA
cgctcttccgcgtctcttaagcttgcgcggcagccatatgggccctatggagatatacaagacagtgtctgcatggaaggtcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56946 - RNA, 292 nt, synthetic construct
  source 1..292: mol_type = other RNA
cgctcttccgcgtctcttaagcttgcgcggcagccatatgggccctatggagatatacaagacagtgtctgcatggaagagagtccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56947 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggtcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56948 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56949 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggtccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56950 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56951 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagtcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56952 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggtcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56953 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgtcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56954 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgtcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56955 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgtcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56956 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagtcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56957 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgtcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56958 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgtcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56959 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgtcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56960 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56961 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagtcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56962 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagtcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56963 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggtcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56964 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgtcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56965 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggtcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56966 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgtcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56967 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgtcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56968 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggtcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56969 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagtcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56970 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgtcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56971 - RNA, 292 nt, synthetic construct
  source 1..292: mol_type = other RNA
cgctcttccgcgtctcttaagcttggggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56972 - RNA, 292 nt, synthetic construct
  source 1..292: mol_type = other RNA
cgctcttccgcgtctcttaagcttgcgcgggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56973 - RNA, 292 nt, synthetic construct
  source 1..292: mol_type = other RNA
cgctcttccgcgtctcttaagcttgcgcggcgggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56974 - RNA, 292 nt, synthetic construct
  source 1..292: mol_type = other RNA
cgctcttccgcgtctcttaagcttgcgcggcagcgggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56975 - RNA, 292 nt, synthetic construct
  source 1..292: mol_type = other RNA
cgctcttccgcgtctcttaagcttgcgcggcagccatgggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56976 - RNA, 292 nt, synthetic construct
  source 1..292: mol_type = other RNA
cgctcttccgcgtctcttaagcttgcgcggcagccatatggggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56977 - RNA, 292 nt, synthetic construct
  source 1..292: mol_type = other RNA
cgctcttccgcgtctcttaagcttgcgcggcagccatatgggcgggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56978 - RNA, 292 nt, synthetic construct
  source 1..292: mol_type = other RNA
cgctcttccgcgtctcttaagcttgcgcggcagccatatgggccctgggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56979 - RNA, 292 nt, synthetic construct
  source 1..292: mol_type = other RNA
cgctcttccgcgtctcttaagcttgcgcggcagccatatgggccctatgggggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56980 - RNA, 292 nt, synthetic construct
  source 1..292: mol_type = other RNA
cgctcttccgcgtctcttaagcttgcgcggcagccatatgggccctatggaggggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56981 - RNA, 292 nt, synthetic construct
  source 1..292: mol_type = other RNA
cgctcttccgcgtctcttaagcttgcgcggcagccatatgggccctatggagatagggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56982 - RNA, 292 nt, synthetic construct
  source 1..292: mol_type = other RNA
cgctcttccgcgtctcttaagcttgcgcggcagccatatgggccctatggagatatacgggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56983 - RNA, 292 nt, synthetic construct
  source 1..292: mol_type = other RNA
cgctcttccgcgtctcttaagcttgcgcggcagccatatgggccctatggagatatacaaggggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56984 - RNA, 292 nt, synthetic construct
  source 1..292: mol_type = other RNA
cgctcttccgcgtctcttaagcttgcgcggcagccatatgggccctatggagatatacaagacaggggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56985 - RNA, 292 nt, synthetic construct
  source 1..292: mol_type = other RNA
cgctcttccgcgtctcttaagcttgcgcggcagccatatgggccctatggagatatacaagacagtggggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56986 - RNA, 292 nt, synthetic construct
  source 1..292: mol_type = other RNA
cgctcttccgcgtctcttaagcttgcgcggcagccatatgggccctatggagatatacaagacagtgtctggggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56987 - RNA, 292 nt, synthetic construct
  source 1..292: mol_type = other RNA
cgctcttccgcgtctcttaagcttgcgcggcagccatatgggccctatggagatatacaagacagtgtctgcagggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56988 - RNA, 292 nt, synthetic construct
  source 1..292: mol_type = other RNA
cgctcttccgcgtctcttaagcttgcgcggcagccatatgggccctatggagatatacaagacagtgtctgcatgggggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56989 - RNA, 292 nt, synthetic construct
  source 1..292: mol_type = other RNA
cgctcttccgcgtctcttaagcttgcgcggcagccatatgggccctatggagatatacaagacagtgtctgcatggaaggggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56990 - RNA, 292 nt, synthetic construct
  source 1..292: mol_type = other RNA
cgctcttccgcgtctcttaagcttgcgcggcagccatatgggccctatggagatatacaagacagtgtctgcatggaagagagggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56991 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56992 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaggggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56993 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56994 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggggggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56995 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56996 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56997 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56998 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 56999 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57000 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57001 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57002 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcggggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57003 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57004 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagggggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57005 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57006 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57007 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57008 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57009 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57010 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57011 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57012 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgggggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57013 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57014 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57015 - RNA, 292 nt, synthetic construct
  source 1..292: mol_type = other RNA
cgctcttccgcgtctcttaagcttgggccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57016 - RNA, 292 nt, synthetic construct
  source 1..292: mol_type = other RNA
cgctcttccgcgtctcttaagcttgcgcggcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57017 - RNA, 292 nt, synthetic construct; identical to SEQ ID NO: 57016
  source 1..292: mol_type = other RNA

SEQ ID NO: 57018 - RNA, 292 nt, synthetic construct
  source 1..292: mol_type = other RNA
cgctcttccgcgtctcttaagcttgcgcggcagcggccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57019 - RNA, 292 nt, synthetic construct
  source 1..292: mol_type = other RNA
cgctcttccgcgtctcttaagcttgcgcggcagccatggcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57020 - RNA, 292 nt, synthetic construct
  source 1..292: mol_type = other RNA
cgctcttccgcgtctcttaagcttgcgcggcagccatatgggcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57021 - RNA, 292 nt, synthetic construct; identical to SEQ ID NO: 57020
  source 1..292: mol_type = other RNA

SEQ ID NO: 57022 - RNA, 292 nt, synthetic construct
  source 1..292: mol_type = other RNA
cgctcttccgcgtctcttaagcttgcgcggcagccatatgggccctggcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57023 - RNA, 292 nt, synthetic construct
  source 1..292: mol_type = other RNA
cgctcttccgcgtctcttaagcttgcgcggcagccatatgggccctatgggcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57024 - RNA, 292 nt, synthetic construct
  source 1..292: mol_type = other RNA
cgctcttccgcgtctcttaagcttgcgcggcagccatatgggccctatggagggcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57025 - RNA, 292 nt, synthetic construct
  source 1..292: mol_type = other RNA
cgctcttccgcgtctcttaagcttgcgcggcagccatatgggccctatggagataggctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57026 - RNA, 292 nt, synthetic construct
  source 1..292: mol_type = other RNA
cgctcttccgcgtctcttaagcttgcgcggcagccatatgggccctatggagatatacggcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57027 - RNA, 292 nt, synthetic construct
  source 1..292: mol_type = other RNA
cgctcttccgcgtctcttaagcttgcgcggcagccatatgggccctatggagatatacaagggcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57028 - RNA, 292 nt, synthetic construct
  source 1..292: mol_type = other RNA
cgctcttccgcgtctcttaagcttgcgcggcagccatatgggccctatggagatatacaagacaggcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57029 - RNA, 292 nt, synthetic construct
  source 1..292: mol_type = other RNA
cgctcttccgcgtctcttaagcttgcgcggcagccatatgggccctatggagatatacaagacagtgggctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57030 - RNA, 292 nt, synthetic construct
  source 1..292: mol_type = other RNA
cgctcttccgcgtctcttaagcttgcgcggcagccatatgggccctatggagatatacaagacagtgtctggcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57031 - RNA, 292 nt, synthetic construct
  source 1..292: mol_type = other RNA
cgctcttccgcgtctcttaagcttgcgcggcagccatatgggccctatggagatatacaagacagtgtctgcaggctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57032 - RNA, 292 nt, synthetic construct
  source 1..292: mol_type = other RNA
cgctcttccgcgtctcttaagcttgcgcggcagccatatgggccctatggagatatacaagacagtgtctgcatggggcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57033 - RNA, 292 nt, synthetic construct
  source 1..292: mol_type = other RNA
cgctcttccgcgtctcttaagcttgcgcggcagccatatgggccctatggagatatacaagacagtgtctgcatggaagggcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57034 - RNA, 292 nt, synthetic construct
  source 1..292: mol_type = other RNA
cgctcttccgcgtctcttaagcttgcgcggcagccatatgggccctatggagatatacaagacagtgtctgcatggaagagaggccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57035 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagggcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57036 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaggcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57037 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgggccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57038 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggggcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57039 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaggcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57040 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgggcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57041 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcggcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57042 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcggcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57043 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcggcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57044 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaggcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57045 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacggcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57046 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcggcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57047 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacggcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57048 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagggcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57049 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaggcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57050 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaggcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57051 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagggcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57052 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtggcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57053 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57054 - RNA, 292 nt, synthetic construct; identical to SEQ ID NO: 57053
  source 1..292: mol_type = other RNA

SEQ ID NO: 57055 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcggcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57056 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgggcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57057 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaggcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57058 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcggcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57059 - RNA, 292 nt, synthetic construct
  source 1..292: mol_type = other RNA
cgctcttccgcgtctcttaagcttggcgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57060 - RNA, 292 nt, synthetic construct
  source 1..292: mol_type = other RNA
cgctcttccgcgtctcttaagcttgcgcgcgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57061 - RNA, 292 nt, synthetic construct
  source 1..292: mol_type = other RNA
cgctcttccgcgtctcttaagcttgcgcggcgcgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57062 - RNA, 292 nt, synthetic construct
  source 1..292: mol_type = other RNA
cgctcttccgcgtctcttaagcttgcgcggcagcgcgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57063 - RNA, 292 nt, synthetic construct
  source 1..292: mol_type = other RNA
cgctcttccgcgtctcttaagcttgcgcggcagccatgcgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57064 - RNA, 292 nt, synthetic construct
  source 1..292: mol_type = other RNA
cgctcttccgcgtctcttaagcttgcgcggcagccatatggcgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57065 - RNA, 292 nt, synthetic construct
  source 1..292: mol_type = other RNA
cgctcttccgcgtctcttaagcttgcgcggcagccatatgggcgcgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57066 - RNA, 292 nt, synthetic construct
  source 1..292: mol_type = other RNA
cgctcttccgcgtctcttaagcttgcgcggcagccatatgggccctgcgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57067 - RNA, 292 nt, synthetic construct
  source 1..292: mol_type = other RNA
cgctcttccgcgtctcttaagcttgcgcggcagccatatgggccctatggcggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57068 - RNA, 292 nt, synthetic construct
  source 1..292: mol_type = other RNA
cgctcttccgcgtctcttaagcttgcgcggcagccatatgggccctatggaggcgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57069 - RNA, 292 nt, synthetic construct
  source 1..292: mol_type = other RNA
cgctcttccgcgtctcttaagcttgcgcggcagccatatgggccctatggagatagcgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57070 - RNA, 292 nt, synthetic construct
  source 1..292: mol_type = other RNA
cgctcttccgcgtctcttaagcttgcgcggcagccatatgggccctatggagatatacgcgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57071 - RNA, 292 nt, synthetic construct
  source 1..292: mol_type = other RNA
cgctcttccgcgtctcttaagcttgcgcggcagccatatgggccctatggagatatacaaggcgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57072 - RNA, 292 nt, synthetic construct
  source 1..292: mol_type = other RNA
cgctcttccgcgtctcttaagcttgcgcggcagccatatgggccctatggagatatacaagacagcggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57073 - RNA, 292 nt, synthetic construct
  source 1..292: mol_type = other RNA
cgctcttccgcgtctcttaagcttgcgcggcagccatatgggccctatggagatatacaagacagtggcgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57074 - RNA, 292 nt, synthetic construct
  source 1..292: mol_type = other RNA
cgctcttccgcgtctcttaagcttgcgcggcagccatatgggccctatggagatatacaagacagtgtctgcggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57075 - RNA, 292 nt, synthetic construct
  source 1..292: mol_type = other RNA
cgctcttccgcgtctcttaagcttgcgcggcagccatatgggccctatggagatatacaagacagtgtctgcagcgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57076 - RNA, 292 nt, synthetic construct
  source 1..292: mol_type = other RNA
cgctcttccgcgtctcttaagcttgcgcggcagccatatgggccctatggagatatacaagacagtgtctgcatgggcgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57077 - RNA, 292 nt, synthetic construct
  source 1..292: mol_type = other RNA
cgctcttccgcgtctcttaagcttgcgcggcagccatatgggccctatggagatatacaagacagtgtctgcatggaaggcgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57078 - RNA, 292 nt, synthetic construct
  source 1..292: mol_type = other RNA
cgctcttccgcgtctcttaagcttgcgcggcagccatatgggccctatggagatatacaagacagtgtctgcatggaagagagcgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57079 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggcgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57080 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagcggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57081 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggcgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57082 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggcggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57083 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagcgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57084 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggcgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57085 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgcgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57086 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgcgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57087 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgcgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57088 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagcgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57089 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgcgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57090 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgcggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57091 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgcgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57092 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggcggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57093 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagcgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57094 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagcgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57095 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggcgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57096 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgcgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57097 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggcgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57098 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgcgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57099 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgcgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57100 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggcggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57101 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagcgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57102 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgcgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57103 - RNA, 292 nt, synthetic construct
  source 1..292: mol_type = other RNA
cgctcttccgcgtctcttaagcttggcccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57104 - RNA, 292 nt, synthetic construct
  source 1..292: mol_type = other RNA
cgctcttccgcgtctcttaagcttgcgcgccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57105 - RNA, 292 nt, synthetic construct
  source 1..292: mol_type = other RNA
cgctcttccgcgtctcttaagcttgcgcggcgccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57106 - RNA, 292 nt, synthetic construct
  source 1..292: mol_type = other RNA
cgctcttccgcgtctcttaagcttgcgcggcagcgcccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57107 - RNA, 292 nt, synthetic construct
  source 1..292: mol_type = other RNA
cgctcttccgcgtctcttaagcttgcgcggcagccatgccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57108 - RNA, 292 nt, synthetic construct
  source 1..292: mol_type = other RNA
cgctcttccgcgtctcttaagcttgcgcggcagccatatggccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57109 - RNA, 292 nt, synthetic construct
  source 1..292: mol_type = other RNA
cgctcttccgcgtctcttaagcttgcgcggcagccatatgggcgcccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57110 - RNA, 292 nt, synthetic construct
  source 1..292: mol_type = other RNA
cgctcttccgcgtctcttaagcttgcgcggcagccatatgggccctgccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57111 - RNA, 292 nt, synthetic construct
  source 1..292: mol_type = other RNA
cgctcttccgcgtctcttaagcttgcgcggcagccatatgggccctatggccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57112 - RNA, 292 nt, synthetic construct
  source 1..292: mol_type = other RNA
cgctcttccgcgtctcttaagcttgcgcggcagccatatgggccctatggaggccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57113 - RNA, 292 nt, synthetic construct
  source 1..292: mol_type = other RNA
cgctcttccgcgtctcttaagcttgcgcggcagccatatgggccctatggagatagcctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57114 - RNA, 292 nt, synthetic construct
  source 1..292: mol_type = other RNA
cgctcttccgcgtctcttaagcttgcgcggcagccatatgggccctatggagatatacgccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57115 - RNA, 292 nt, synthetic construct
  source 1..292: mol_type = other RNA
cgctcttccgcgtctcttaagcttgcgcggcagccatatgggccctatggagatatacaaggccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57116 - RNA, 292 nt, synthetic construct
  source 1..292: mol_type = other RNA
cgctcttccgcgtctcttaagcttgcgcggcagccatatgggccctatggagatatacaagacagccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57117 - RNA, 292 nt, synthetic construct
  source 1..292: mol_type = other RNA
cgctcttccgcgtctcttaagcttgcgcggcagccatatgggccctatggagatatacaagacagtggcctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57118 - RNA, 292 nt, synthetic construct
  source 1..292: mol_type = other RNA
cgctcttccgcgtctcttaagcttgcgcggcagccatatgggccctatggagatatacaagacagtgtctgccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57119 - RNA, 292 nt, synthetic construct
  source 1..292: mol_type = other RNA
cgctcttccgcgtctcttaagcttgcgcggcagccatatgggccctatggagatatacaagacagtgtctgcagcctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57120 - RNA, 292 nt, synthetic construct
  source 1..292: mol_type = other RNA
cgctcttccgcgtctcttaagcttgcgcggcagccatatgggccctatggagatatacaagacagtgtctgcatgggccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57121 - RNA, 292 nt, synthetic construct
  source 1..292: mol_type = other RNA
cgctcttccgcgtctcttaagcttgcgcggcagccatatgggccctatggagatatacaagacagtgtctgcatggaaggccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57122 - RNA, 292 nt, synthetic construct
  source 1..292: mol_type = other RNA
cgctcttccgcgtctcttaagcttgcgcggcagccatatgggccctatggagatatacaagacagtgtctgcatggaagagagcccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57123 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaggccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57124 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57125 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtggcccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57126 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57127 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtagccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57128 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactggccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57129 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcgccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57130 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcgccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57131 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcgccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57132 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagagccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57133 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacgccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57134 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57135 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57136 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57137 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtagccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57138 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactagccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57139 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaaggccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57140 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtgccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57141 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttggccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57142 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcgccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57143 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57144 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57145 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaagccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57146 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcgccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57147 - RNA, 292 nt, synthetic construct
  source 1..292: mol_type = other RNA
cgctcttccgcgtctcttaagcttgcagcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57148 - RNA, 292 nt, synthetic construct
  source 1..292: mol_type = other RNA
cgctcttccgcgtctcttaagcttgcgccagggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57149 - RNA, 292 nt, synthetic construct
  source 1..292: mol_type = other RNA
cgctcttccgcgtctcttaagcttgcgcggccagagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57150 - RNA, 292 nt, synthetic construct
  source 1..292: mol_type = other RNA
cgctcttccgcgtctcttaagcttgcgcggcagccagcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57151 - RNA, 292 nt, synthetic construct
  source 1..292: mol_type = other RNA
cgctcttccgcgtctcttaagcttgcgcggcagccatcagatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57152 - RNA, 292 nt, synthetic construct
  source 1..292: mol_type = other RNA
cgctcttccgcgtctcttaagcttgcgcggcagccatatgcagggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57153 - RNA, 292 nt, synthetic construct
  source 1..292: mol_type = other RNA
cgctcttccgcgtctcttaagcttgcgcggcagccatatgggccagcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57154 - RNA, 292 nt, synthetic construct
  source 1..292: mol_type = other RNA
cgctcttccgcgtctcttaagcttgcgcggcagccatatgggccctcagatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57155 - RNA, 292 nt, synthetic construct
  source 1..292: mol_type = other RNA
cgctcttccgcgtctcttaagcttgcgcggcagccatatgggccctatgcaggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57156 - RNA, 292 nt, synthetic construct
  source 1..292: mol_type = other RNA
cgctcttccgcgtctcttaagcttgcgcggcagccatatgggccctatggagcagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57157 - RNA, 292 nt, synthetic construct
  source 1..292: mol_type = other RNA
cgctcttccgcgtctcttaagcttgcgcggcagccatatgggccctatggagatacagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57158 - RNA, 292 nt, synthetic construct
  source 1..292: mol_type = other RNA
cgctcttccgcgtctcttaagcttgcgcggcagccatatgggccctatggagatataccagaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57159 - RNA, 292 nt, synthetic construct
  source 1..292: mol_type = other RNA
cgctcttccgcgtctcttaagcttgcgcggcagccatatgggccctatggagatatacaagcagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57160 - RNA, 292 nt, synthetic construct
  source 1..292: mol_type = other RNA
cgctcttccgcgtctcttaagcttgcgcggcagccatatgggccctatggagatatacaagacacaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57161 - RNA, 292 nt, synthetic construct
  source 1..292: mol_type = other RNA
cgctcttccgcgtctcttaagcttgcgcggcagccatatgggccctatggagatatacaagacagtgcagtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57162 - RNA, 292 nt, synthetic construct
  source 1..292: mol_type = other RNA
cgctcttccgcgtctcttaagcttgcgcggcagccatatgggccctatggagatatacaagacagtgtctcaggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57163 - RNA, 292 nt, synthetic construct
  source 1..292: mol_type = other RNA
cgctcttccgcgtctcttaagcttgcgcggcagccatatgggccctatggagatatacaagacagtgtctgcacagtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57164 - RNA, 292 nt, synthetic construct
  source 1..292: mol_type = other RNA
cgctcttccgcgtctcttaagcttgcgcggcagccatatgggccctatggagatatacaagacagtgtctgcatggcagaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57165 - RNA, 292 nt, synthetic construct
  source 1..292: mol_type = other RNA
cgctcttccgcgtctcttaagcttgcgcggcagccatatgggccctatggagatatacaagacagtgtctgcatggaagcagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57166 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57167 - RNA, 292 nt, synthetic construct; identical to SEQ ID NO: 57166
  source 1..292: mol_type = other RNA

SEQ ID NO: 57168 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccacaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57169 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcagcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57170 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggcaggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57171 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtacagctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57172 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgcagagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57173 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagccagctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57174 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctccagttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57175 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttccagagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57176 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagacagaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57177 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaaccagatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57178 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatccaggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57179 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccagaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57180 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57181 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57182 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacagaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57183 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57184 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57185 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcagggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57186 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccagttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57187 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccagttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57188 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcaggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57189 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacagagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57190 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagccagggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57191 - RNA, 292 nt, synthetic construct
  source 1..292: mol_type = other RNA
cgctcttccgcgtctcttaagcttgcaccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57192 - RNA, 292 nt, synthetic construct
  source 1..292: mol_type = other RNA
cgctcttccgcgtctcttaagcttgcgccacggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57193 - RNA, 292 nt, synthetic construct
  source 1..292: mol_type = other RNA
cgctcttccgcgtctcttaagcttgcgcggccacagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57194 - RNA, 292 nt, synthetic construct
  source 1..292: mol_type = other RNA
cgctcttccgcgtctcttaagcttgcgcggcagccaccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57195 - RNA, 292 nt, synthetic construct
  source 1..292: mol_type = other RNA
cgctcttccgcgtctcttaagcttgcgcggcagccatcacatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57196 - RNA, 292 nt, synthetic construct
  source 1..292: mol_type = other RNA
cgctcttccgcgtctcttaagcttgcgcggcagccatatgcacggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57197 - RNA, 292 nt, synthetic construct
  source 1..292: mol_type = other RNA
cgctcttccgcgtctcttaagcttgcgcggcagccatatgggccaccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57198 - RNA, 292 nt, synthetic construct
  source 1..292: mol_type = other RNA
cgctcttccgcgtctcttaagcttgcgcggcagccatatgggccctcacatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57199 - RNA, 292 nt, synthetic construct
  source 1..292: mol_type = other RNA
cgctcttccgcgtctcttaagcttgcgcggcagccatatgggccctatgcacgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57200 - RNA, 292 nt, synthetic construct
  source 1..292: mol_type = other RNA
cgctcttccgcgtctcttaagcttgcgcggcagccatatgggccctatggagcacatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57201 - RNA, 292 nt, synthetic construct
  source 1..292: mol_type = other RNA
cgctcttccgcgtctcttaagcttgcgcggcagccatatgggccctatggagatacactacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57202 - RNA, 292 nt, synthetic construct
  source 1..292: mol_type = other RNA
cgctcttccgcgtctcttaagcttgcgcggcagccatatgggccctatggagatataccacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57203 - RNA, 292 nt, synthetic construct
  source 1..292: mol_type = other RNA
cgctcttccgcgtctcttaagcttgcgcggcagccatatgggccctatggagatatacaagcacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57204 - RNA, 292 nt, synthetic construct
  source 1..292: mol_type = other RNA
cgctcttccgcgtctcttaagcttgcgcggcagccatatgggccctatggagatatacaagacacacgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57205 - RNA, 292 nt, synthetic construct
  source 1..292: mol_type = other RNA
cgctcttccgcgtctcttaagcttgcgcggcagccatatgggccctatggagatatacaagacagtgcactctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57206 - RNA, 292 nt, synthetic construct
  source 1..292: mol_type = other RNA
cgctcttccgcgtctcttaagcttgcgcggcagccatatgggccctatggagatatacaagacagtgtctcacgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57207 - RNA, 292 nt, synthetic construct
  source 1..292: mol_type = other RNA
cgctcttccgcgtctcttaagcttgcgcggcagccatatgggccctatggagatatacaagacagtgtctgcacactggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57208 - RNA, 292 nt, synthetic construct
  source 1..292: mol_type = other RNA
cgctcttccgcgtctcttaagcttgcgcggcagccatatgggccctatggagatatacaagacagtgtctgcatggcacaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57209 - RNA, 292 nt, synthetic construct
  source 1..292: mol_type = other RNA
cgctcttccgcgtctcttaagcttgcgcggcagccatatgggccctatggagatatacaagacagtgtctgcatggaagcacagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57210 - RNA, 292 nt, synthetic construct
  source 1..292: mol_type = other RNA
cgctcttccgcgtctcttaagcttgcgcggcagccatatgggccctatggagatatacaagacagtgtctgcatggaagagacaccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57211 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagcacccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57212 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccacacgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57213 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcaccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57214 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggcacgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57215 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtacacctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57216 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgcacagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57217 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagccacctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57218 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctccacttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57219 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttccacagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57220 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagacacaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57221 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaaccacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57222 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatccacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57223 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57224 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57225 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacacctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57226 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacacaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57227 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcacagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57228 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcacttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57229 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcacggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57230 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccacttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57231 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccacttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57232 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcacgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57233 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacacagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57234 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagccacggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57235 - RNA, 292 nt, synthetic construct
  source 1..292: mol_type = other RNA
cgctcttccgcgtctcttaagcttgctgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57236 - RNA, 292 nt, synthetic construct
  source 1..292: mol_type = other RNA
cgctcttccgcgtctcttaagcttgcgcctgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57237 - RNA, 292 nt, synthetic construct
  source 1..292: mol_type = other RNA
cgctcttccgcgtctcttaagcttgcgcggcctgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57238 - RNA, 292 nt, synthetic construct
  source 1..292: mol_type = other RNA
cgctcttccgcgtctcttaagcttgcgcggcagcctgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57239 - RNA, 292 nt, synthetic construct
  source 1..292: mol_type = other RNA
cgctcttccgcgtctcttaagcttgcgcggcagccatctgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57240 - RNA, 292 nt, synthetic construct
  source 1..292: mol_type = other RNA
cgctcttccgcgtctcttaagcttgcgcggcagccatatgctgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57241 - RNA, 292 nt, synthetic construct
  source 1..292: mol_type = other RNA
cgctcttccgcgtctcttaagcttgcgcggcagccatatgggcctgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57242 - RNA, 292 nt, synthetic construct
  source 1..292: mol_type = other RNA
cgctcttccgcgtctcttaagcttgcgcggcagccatatgggccctctgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57243 - RNA, 292 nt, synthetic construct
  source 1..292: mol_type = other RNA
cgctcttccgcgtctcttaagcttgcgcggcagccatatgggccctatgctggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57244 - RNA, 292 nt, synthetic construct
  source 1..292: mol_type = other RNA
cgctcttccgcgtctcttaagcttgcgcggcagccatatgggccctatggagctgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57245 - RNA, 292 nt, synthetic construct
  source 1..292: mol_type = other RNA
cgctcttccgcgtctcttaagcttgcgcggcagccatatgggccctatggagatactgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57246 - RNA, 292 nt, synthetic construct
  source 1..292: mol_type = other RNA
cgctcttccgcgtctcttaagcttgcgcggcagccatatgggccctatggagatatacctgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57247 - RNA, 292 nt, synthetic construct
  source 1..292: mol_type = other RNA
cgctcttccgcgtctcttaagcttgcgcggcagccatatgggccctatggagatatacaagctgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57248 - RNA, 292 nt, synthetic construct
  source 1..292: mol_type = other RNA
cgctcttccgcgtctcttaagcttgcgcggcagccatatgggccctatggagatatacaagacactggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57249 - RNA, 292 nt, synthetic construct
  source 1..292: mol_type = other RNA
cgctcttccgcgtctcttaagcttgcgcggcagccatatgggccctatggagatatacaagacagtgctgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57250 - RNA, 292 nt, synthetic construct
  source 1..292: mol_type = other RNA
cgctcttccgcgtctcttaagcttgcgcggcagccatatgggccctatggagatatacaagacagtgtctctggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57251 - RNA, 292 nt, synthetic construct
  source 1..292: mol_type = other RNA
cgctcttccgcgtctcttaagcttgcgcggcagccatatgggccctatggagatatacaagacagtgtctgcactgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57252 - RNA, 292 nt, synthetic construct
  source 1..292: mol_type = other RNA
cgctcttccgcgtctcttaagcttgcgcggcagccatatgggccctatggagatatacaagacagtgtctgcatggctgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57253 - RNA, 292 nt, synthetic construct
  source 1..292: mol_type = other RNA
cgctcttccgcgtctcttaagcttgcgcggcagccatatgggccctatggagatatacaagacagtgtctgcatggaagctgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57254 - RNA, 292 nt, synthetic construct
  source 1..292: mol_type = other RNA
cgctcttccgcgtctcttaagcttgcgcggcagccatatgggccctatggagatatacaagacagtgtctgcatggaagagactgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57255 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagctgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57256 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccactggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57257 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgctgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57258 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggctggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57259 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57260 - RNA, 292 nt, synthetic construct; identical to SEQ ID NO: 57259
  source 1..292: mol_type = other RNA

SEQ ID NO: 57261 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57262 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcctgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57263 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcctgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57264 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagactgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57265 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacctgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57266 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcctggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57267 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacctgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57268 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagctggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57269 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57270 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactactgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57271 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagctgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57272 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtctgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57273 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgctgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57274 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcctgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57275 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcctgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57276 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgctggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57277 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaactgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57278 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcctgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57279 - RNA, 292 nt, synthetic construct
  source 1..292: mol_type = other RNA
cgctcttccgcgtctcttaagcttgctccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57280 - RNA, 292 nt, synthetic construct
  source 1..292: mol_type = other RNA
cgctcttccgcgtctcttaagcttgcgcctcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57281 - RNA, 292 nt, synthetic construct
  source 1..292: mol_type = other RNA
cgctcttccgcgtctcttaagcttgcgcggcctcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57282 - RNA, 292 nt, synthetic construct
  source 1..292: mol_type = other RNA
cgctcttccgcgtctcttaagcttgcgcggcagcctccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57283 - RNA, 292 nt, synthetic construct
  source 1..292: mol_type = other RNA
cgctcttccgcgtctcttaagcttgcgcggcagccatctcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57284 - RNA, 292 nt, synthetic construct
  source 1..292: mol_type = other RNA
cgctcttccgcgtctcttaagcttgcgcggcagccatatgctcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57285 - RNA, 292 nt, synthetic construct
  source 1..292: mol_type = other RNA
cgctcttccgcgtctcttaagcttgcgcggcagccatatgggcctccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57286 - RNA, 292 nt, synthetic construct
  source 1..292: mol_type = other RNA
cgctcttccgcgtctcttaagcttgcgcggcagccatatgggccctctcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57287 - RNA, 292 nt, synthetic construct
  source 1..292: mol_type = other RNA
cgctcttccgcgtctcttaagcttgcgcggcagccatatgggccctatgctcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57288 - RNA, 292 nt, synthetic construct
  source 1..292: mol_type = other RNA
cgctcttccgcgtctcttaagcttgcgcggcagccatatgggccctatggagctcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57289 - RNA, 292 nt, synthetic construct
  source 1..292: mol_type = other RNA
cgctcttccgcgtctcttaagcttgcgcggcagccatatgggccctatggagatactctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57290 - RNA, 292 nt, synthetic construct
  source 1..292: mol_type = other RNA
cgctcttccgcgtctcttaagcttgcgcggcagccatatgggccctatggagatatacctcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57291 - RNA, 292 nt, synthetic construct
  source 1..292: mol_type = other RNA
cgctcttccgcgtctcttaagcttgcgcggcagccatatgggccctatggagatatacaagctcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57292 - RNA, 292 nt, synthetic construct
  source 1..292: mol_type = other RNA
cgctcttccgcgtctcttaagcttgcgcggcagccatatgggccctatggagatatacaagacactcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57293 - RNA, 292 nt, synthetic construct
  source 1..292: mol_type = other RNA
cgctcttccgcgtctcttaagcttgcgcggcagccatatgggccctatggagatatacaagacagtgctctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57294 - RNA, 292 nt, synthetic construct
  source 1..292: mol_type = other RNA
cgctcttccgcgtctcttaagcttgcgcggcagccatatgggccctatggagatatacaagacagtgtctctcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57295 - RNA, 292 nt, synthetic construct
  source 1..292: mol_type = other RNA
cgctcttccgcgtctcttaagcttgcgcggcagccatatgggccctatggagatatacaagacagtgtctgcactctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57296 - RNA, 292 nt, synthetic construct
  source 1..292: mol_type = other RNA
cgctcttccgcgtctcttaagcttgcgcggcagccatatgggccctatggagatatacaagacagtgtctgcatggctcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57297 - RNA, 292 nt, synthetic construct
  source 1..292: mol_type = other RNA
cgctcttccgcgtctcttaagcttgcgcggcagccatatgggccctatggagatatacaagacagtgtctgcatggaagctcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57298 - RNA, 292 nt, synthetic construct
  source 1..292: mol_type = other RNA
cgctcttccgcgtctcttaagcttgcgcggcagccatatgggccctatggagatatacaagacagtgtctgcatggaagagactccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57299 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagctcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57300 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccactcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57301 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgctccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57302 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggctcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57303 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57304 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgctcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57305 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57306 - RNA, 292 nt, synthetic construct; identical to SEQ ID NO: 57305
  source 1..292: mol_type = other RNA

SEQ ID NO: 57307 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcctcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57308 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagactcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57309 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacctcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57310 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcctcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57311 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacctcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57312 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagctcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57313 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57314 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactactcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57315 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagctcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57316 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtctcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57317 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgctcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57318 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcctcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57319 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcctcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57320 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgctcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57321 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaactcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57322 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcctcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57323 - RNA, 292 nt, synthetic construct
  source 1..292: mol_type = other RNA
cgctcttccgcgtctcttaagcttgcggcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57324 - RNA, 292 nt, synthetic construct
  source 1..292: mol_type = other RNA
cgctcttccgcgtctcttaagcttgcgccggggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57325 - RNA, 292 nt, synthetic construct
  source 1..292: mol_type = other RNA
cgctcttccgcgtctcttaagcttgcgcggccggagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57326 - RNA, 292 nt, synthetic construct
  source 1..292: mol_type = other RNA
cgctcttccgcgtctcttaagcttgcgcggcagccggcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57327 - RNA, 292 nt, synthetic construct
  source 1..292: mol_type = other RNA
cgctcttccgcgtctcttaagcttgcgcggcagccatcggatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57328 - RNA, 292 nt, synthetic construct
  source 1..292: mol_type = other RNA
cgctcttccgcgtctcttaagcttgcgcggcagccatatgcggggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57329 - RNA, 292 nt, synthetic construct
  source 1..292: mol_type = other RNA
cgctcttccgcgtctcttaagcttgcgcggcagccatatgggccggcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57330 - RNA, 292 nt, synthetic construct
  source 1..292: mol_type = other RNA
cgctcttccgcgtctcttaagcttgcgcggcagccatatgggccctcggatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57331 - RNA, 292 nt, synthetic construct
  source 1..292: mol_type = other RNA
cgctcttccgcgtctcttaagcttgcgcggcagccatatgggccctatgcgggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57332 - RNA, 292 nt, synthetic construct
  source 1..292: mol_type = other RNA
cgctcttccgcgtctcttaagcttgcgcggcagccatatgggccctatggagcggatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57333 - RNA, 292 nt, synthetic construct
  source 1..292: mol_type = other RNA
cgctcttccgcgtctcttaagcttgcgcggcagccatatgggccctatggagatacggtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57334 - RNA, 292 nt, synthetic construct
  source 1..292: mol_type = other RNA
cgctcttccgcgtctcttaagcttgcgcggcagccatatgggccctatggagatataccggaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57335 - RNA, 292 nt, synthetic construct
  source 1..292: mol_type = other RNA
cgctcttccgcgtctcttaagcttgcgcggcagccatatgggccctatggagatatacaagcggacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57336 - RNA, 292 nt, synthetic construct
  source 1..292: mol_type = other RNA
cgctcttccgcgtctcttaagcttgcgcggcagccatatgggccctatggagatatacaagacacgggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57337 - RNA, 292 nt, synthetic construct
  source 1..292: mol_type = other RNA
cgctcttccgcgtctcttaagcttgcgcggcagccatatgggccctatggagatatacaagacagtgcggtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57338 - RNA, 292 nt, synthetic construct
  source 1..292: mol_type = other RNA
cgctcttccgcgtctcttaagcttgcgcggcagccatatgggccctatggagatatacaagacagtgtctcgggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57339 - RNA, 292 nt, synthetic construct
  source 1..292: mol_type = other RNA
cgctcttccgcgtctcttaagcttgcgcggcagccatatgggccctatggagatatacaagacagtgtctgcacggtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57340 - RNA, 292 nt, synthetic construct
  source 1..292: mol_type = other RNA
cgctcttccgcgtctcttaagcttgcgcggcagccatatgggccctatggagatatacaagacagtgtctgcatggcggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57341 - RNA, 292 nt, synthetic construct
  source 1..292: mol_type = other RNA
cgctcttccgcgtctcttaagcttgcgcggcagccatatgggccctatggagatatacaagacagtgtctgcatggaagcggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57342 - RNA, 292 nt, synthetic construct
  source 1..292: mol_type = other RNA
cgctcttccgcgtctcttaagcttgcgcggcagccatatgggccctatggagatatacaagacagtgtctgcatggaagagacggcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57343 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagcggccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57344 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccacgggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57345 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57346 - RNA, 292 nt, synthetic construct; identical to SEQ ID NO: 57345
  source 1..292: mol_type = other RNA

SEQ ID NO: 57347 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtacggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57348 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgcggagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57349 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagccggctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57350 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctccggttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57351 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttccggagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57352 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagacggaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57353 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaaccggatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57354 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatccgggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57355 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccggaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57356 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcgggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57357 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacggctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57358 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacggaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57359 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcggagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57360 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcggttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57361 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcggggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57362 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccggttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57363 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccggttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57364 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcgggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57365 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacggagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57366 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagccggggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57367 - RNA, 292 nt, synthetic construct
  source 1..292: mol_type = other RNA
cgctcttccgcgtctcttaagcttgcgccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57368 - RNA, 292 nt, synthetic construct; identical to SEQ ID NO: 57367
  source 1..292: mol_type = other RNA

SEQ ID NO: 57369 - RNA, 292 nt, synthetic construct
  source 1..292: mol_type = other RNA
cgctcttccgcgtctcttaagcttgcgcggccgcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57370 - RNA, 292 nt, synthetic construct
  source 1..292: mol_type = other RNA
cgctcttccgcgtctcttaagcttgcgcggcagccgccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57371 - RNA, 292 nt, synthetic construct
  source 1..292: mol_type = other RNA
cgctcttccgcgtctcttaagcttgcgcggcagccatcgcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57372 - RNA, 292 nt, synthetic construct
  source 1..292: mol_type = other RNA
cgctcttccgcgtctcttaagcttgcgcggcagccatatgcgcggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57373 - RNA, 292 nt, synthetic construct
  source 1..292: mol_type = other RNA
cgctcttccgcgtctcttaagcttgcgcggcagccatatgggccgccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57374 - RNA, 292 nt, synthetic construct
  source 1..292: mol_type = other RNA
cgctcttccgcgtctcttaagcttgcgcggcagccatatgggccctcgcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57375 - RNA, 292 nt, synthetic construct
  source 1..292: mol_type = other RNA
cgctcttccgcgtctcttaagcttgcgcggcagccatatgggccctatgcgcgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57376 - RNA, 292 nt, synthetic construct
  source 1..292: mol_type = other RNA
cgctcttccgcgtctcttaagcttgcgcggcagccatatgggccctatggagcgcatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57377 - RNA, 292 nt, synthetic construct
  source 1..292: mol_type = other RNA
cgctcttccgcgtctcttaagcttgcgcggcagccatatgggccctatggagatacgctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57378 - RNA, 292 nt, synthetic construct
  source 1..292: mol_type = other RNA
cgctcttccgcgtctcttaagcttgcgcggcagccatatgggccctatggagatataccgcaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57379 - RNA, 292 nt, synthetic construct
  source 1..292: mol_type = other RNA
cgctcttccgcgtctcttaagcttgcgcggcagccatatgggccctatggagatatacaagcgcacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57380 - RNA, 292 nt, synthetic construct
  source 1..292: mol_type = other RNA
cgctcttccgcgtctcttaagcttgcgcggcagccatatgggccctatggagatatacaagacacgcgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57381 - RNA, 292 nt, synthetic construct
  source 1..292: mol_type = other RNA
cgctcttccgcgtctcttaagcttgcgcggcagccatatgggccctatggagatatacaagacagtgcgctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57382 - RNA, 292 nt, synthetic construct
  source 1..292: mol_type = other RNA
cgctcttccgcgtctcttaagcttgcgcggcagccatatgggccctatggagatatacaagacagtgtctcgcgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57383 - RNA, 292 nt, synthetic construct
  source 1..292: mol_type = other RNA
cgctcttccgcgtctcttaagcttgcgcggcagccatatgggccctatggagatatacaagacagtgtctgcacgctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57384 - RNA, 292 nt, synthetic construct
  source 1..292: mol_type = other RNA
cgctcttccgcgtctcttaagcttgcgcggcagccatatgggccctatggagatatacaagacagtgtctgcatggcgcaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57385 - RNA, 292 nt, synthetic construct
  source 1..292: mol_type = other RNA
cgctcttccgcgtctcttaagcttgcgcggcagccatatgggccctatggagatatacaagacagtgtctgcatggaagcgcagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57386 - RNA, 292 nt, synthetic construct
  source 1..292: mol_type = other RNA
cgctcttccgcgtctcttaagcttgcgcggcagccatatgggccctatggagatatacaagacagtgtctgcatggaagagacgccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57387 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagcgcccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57388 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccacgcgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57389 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57390 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggcgcgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57391 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtacgcctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57392 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgcgcagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57393 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagccgcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57394 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctccgcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57395 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttccgcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57396 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagacgcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57397 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaaccgcatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57398 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatccgcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57399 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccgcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57400 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcgcgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57401 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacgcctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57402 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacgcaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57403 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcgcagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57404 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcgcttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57405 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcgcggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57406 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccgcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57407 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccgcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57408 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcgcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57409 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacgcagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57410 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagccgcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57411 - RNA, 292 nt, synthetic construct
  source 1..292: mol_type = other RNA
cgctcttccgcgtctcttaagcttgccgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57412 - RNA, 292 nt, synthetic construct
  source 1..292: mol_type = other RNA
cgctcttccgcgtctcttaagcttgcgcccgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57413 - RNA, 292 nt, synthetic construct
  source 1..292: mol_type = other RNA
cgctcttccgcgtctcttaagcttgcgcggcccgagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57414 - RNA, 292 nt, synthetic construct
  source 1..292: mol_type = other RNA
cgctcttccgcgtctcttaagcttgcgcggcagcccgcatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57415 - RNA, 292 nt, synthetic construct
  source 1..292: mol_type = other RNA
cgctcttccgcgtctcttaagcttgcgcggcagccatccgatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57416 - RNA, 292 nt, synthetic construct
  source 1..292: mol_type = other RNA
cgctcttccgcgtctcttaagcttgcgcggcagccatatgccgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57417 - RNA, 292 nt, synthetic construct
  source 1..292: mol_type = other RNA
cgctcttccgcgtctcttaagcttgcgcggcagccatatgggcccgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57418 - RNA, 292 nt, synthetic construct
  source 1..292: mol_type = other RNA
cgctcttccgcgtctcttaagcttgcgcggcagccatatgggccctccgatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57419 - RNA, 292 nt, synthetic construct
  source 1..292: mol_type = other RNA
cgctcttccgcgtctcttaagcttgcgcggcagccatatgggccctatgccggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57420 - RNA, 292 nt, synthetic construct
  source 1..292: mol_type = other RNA
cgctcttccgcgtctcttaagcttgcgcggcagccatatgggccctatggagccgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57421 - RNA, 292 nt, synthetic construct
  source 1..292: mol_type = other RNA
cgctcttccgcgtctcttaagcttgcgcggcagccatatgggccctatggagataccgtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57422 - RNA, 292 nt, synthetic construct
  source 1..292: mol_type = other RNA
cgctcttccgcgtctcttaagcttgcgcggcagccatatgggccctatggagatatacccgaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57423 - RNA, 292 nt, synthetic construct
  source 1..292: mol_type = other RNA
cgctcttccgcgtctcttaagcttgcgcggcagccatatgggccctatggagatatacaagccgacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57424 - RNA, 292 nt, synthetic construct
  source 1..292: mol_type = other RNA
cgctcttccgcgtctcttaagcttgcgcggcagccatatgggccctatggagatatacaagacaccggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57425 - RNA, 292 nt, synthetic construct
  source 1..292: mol_type = other RNA
cgctcttccgcgtctcttaagcttgcgcggcagccatatgggccctatggagatatacaagacagtgccgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57426 - RNA, 292 nt, synthetic construct
  source 1..292: mol_type = other RNA
cgctcttccgcgtctcttaagcttgcgcggcagccatatgggccctatggagatatacaagacagtgtctccggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57427 - RNA, 292 nt, synthetic construct
  source 1..292: mol_type = other RNA
cgctcttccgcgtctcttaagcttgcgcggcagccatatgggccctatggagatatacaagacagtgtctgcaccgtggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57428 - RNA, 292 nt, synthetic construct
  source 1..292: mol_type = other RNA
cgctcttccgcgtctcttaagcttgcgcggcagccatatgggccctatggagatatacaagacagtgtctgcatggccgaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57429 - RNA, 292 nt, synthetic construct
  source 1..292: mol_type = other RNA
cgctcttccgcgtctcttaagcttgcgcggcagccatatgggccctatggagatatacaagacagtgtctgcatggaagccgagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57430 - RNA, 292 nt, synthetic construct
  source 1..292: mol_type = other RNA
cgctcttccgcgtctcttaagcttgcgcggcagccatatgggccctatggagatatacaagacagtgtctgcatggaagagaccgcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57431 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccgccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57432 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccaccggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57433 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgccgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57434 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggccggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57435 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtaccgctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57436 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgccgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57437 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcccgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57438 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcccgttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57439 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcccgagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57440 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaccgaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57441 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacccgatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57442 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcccggacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57443 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacccgaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57444 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagccggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57445 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaccgctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57446 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaccgaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57447 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagccgagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57448 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtccgttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57449 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgccgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57450 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcccgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57451 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcccgttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57452 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgccggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57453 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaccgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57454 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagcccgggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57455 - RNA, 292 nt, synthetic construct
  source 1..292: mol_type = other RNA
cgctcttccgcgtctcttaagcttgccccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57456 - RNA, 292 nt, synthetic construct
  source 1..292: mol_type = other RNA
cgctcttccgcgtctcttaagcttgcgccccggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57457 - RNA, 292 nt, synthetic construct
  source 1..292: mol_type = other RNA
cgctcttccgcgtctcttaagcttgcgcggccccagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57458 - RNA, 292 nt, synthetic construct
  source 1..292: mol_type = other RNA
cgctcttccgcgtctcttaagcttgcgcggcagcccccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57459 - RNA, 292 nt, synthetic construct
  source 1..292: mol_type = other RNA
cgctcttccgcgtctcttaagcttgcgcggcagccatcccatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57460 - RNA, 292 nt, synthetic construct
  source 1..292: mol_type = other RNA
cgctcttccgcgtctcttaagcttgcgcggcagccatatgcccggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57461 - RNA, 292 nt, synthetic construct
  source 1..292: mol_type = other RNA
cgctcttccgcgtctcttaagcttgcgcggcagccatatgggcccccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57462 - RNA, 292 nt, synthetic construct
  source 1..292: mol_type = other RNA
cgctcttccgcgtctcttaagcttgcgcggcagccatatgggccctcccatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57463 - RNA, 292 nt, synthetic construct
  source 1..292: mol_type = other RNA
cgctcttccgcgtctcttaagcttgcgcggcagccatatgggccctatgcccgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57464 - RNA, 292 nt, synthetic construct
  source 1..292: mol_type = other RNA
cgctcttccgcgtctcttaagcttgcgcggcagccatatgggccctatggagcccatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57465 - RNA, 292 nt, synthetic construct
  source 1..292: mol_type = other RNA
cgctcttccgcgtctcttaagcttgcgcggcagccatatgggccctatggagataccctacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57466 - RNA, 292 nt, synthetic construct
  source 1..292: mol_type = other RNA
cgctcttccgcgtctcttaagcttgcgcggcagccatatgggccctatggagatataccccaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57467 - RNA, 292 nt, synthetic construct
  source 1..292: mol_type = other RNA
cgctcttccgcgtctcttaagcttgcgcggcagccatatgggccctatggagatatacaagcccacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57468 - RNA, 292 nt, synthetic construct
  source 1..292: mol_type = other RNA
cgctcttccgcgtctcttaagcttgcgcggcagccatatgggccctatggagatatacaagacacccgtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57469 - RNA, 292 nt, synthetic construct
  source 1..292: mol_type = other RNA
cgctcttccgcgtctcttaagcttgcgcggcagccatatgggccctatggagatatacaagacagtgccctctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57470 - RNA, 292 nt, synthetic construct
  source 1..292: mol_type = other RNA
cgctcttccgcgtctcttaagcttgcgcggcagccatatgggccctatggagatatacaagacagtgtctcccgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57471 - RNA, 292 nt, synthetic construct
  source 1..292: mol_type = other RNA
cgctcttccgcgtctcttaagcttgcgcggcagccatatgggccctatggagatatacaagacagtgtctgcaccctggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57472 - RNA, 292 nt, synthetic construct
  source 1..292: mol_type = other RNA
cgctcttccgcgtctcttaagcttgcgcggcagccatatgggccctatggagatatacaagacagtgtctgcatggcccaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57473 - RNA, 292 nt, synthetic construct
  source 1..292: mol_type = other RNA
cgctcttccgcgtctcttaagcttgcgcggcagccatatgggccctatggagatatacaagacagtgtctgcatggaagcccagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57474 - RNA, 292 nt, synthetic construct
  source 1..292: mol_type = other RNA
cgctcttccgcgtctcttaagcttgcgcggcagccatatgggccctatggagatatacaagacagtgtctgcatggaagagaccccagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57475 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagcccccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57476 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccacccgtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57477 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgccccgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57478 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcggcccgtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57479 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtacccctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57480 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgcccagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57481 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagccccctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57482 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctccccttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57483 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttccccagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57484 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagacccaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57485 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaaccccatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57486 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatccccgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57487 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgaccccaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57488 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagcccgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57489 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtacccctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57490 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactacccaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57491 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagcccagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57492 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtcccttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57493 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgcccggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57494 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggccccttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57495 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttccccttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57496 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgcccgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57497 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaacccagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57498 - RNA, 292 nt, synthetic construct
  source 1..292: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaagccccggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57499 - RNA, 286 nt, synthetic construct
  source 1..286: mol_type = other RNA
cgctcttccgcgtctcttaagccgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57500 - RNA, 286 nt, synthetic construct
  source 1..286: mol_type = other RNA
cgctcttccgcgtctcttaagcttgggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57501 - RNA, 286 nt, synthetic construct
  source 1..286: mol_type = other RNA
cgctcttccgcgtctcttaagcttgcgcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57502 - RNA, 286 nt, synthetic construct
  source 1..286: mol_type = other RNA
cgctcttccgcgtctcttaagcttgcgcggccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57503 - RNA, 286 nt, synthetic construct
  source 1..286: mol_type = other RNA
cgctcttccgcgtctcttaagcttgcgcggcagcatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57504 - RNA, 286 nt, synthetic construct
  source 1..286: mol_type = other RNA
cgctcttccgcgtctcttaagcttgcgcggcagccatggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57505 - RNA, 286 nt, synthetic construct
  source 1..286: mol_type = other RNA
cgctcttccgcgtctcttaagcttgcgcggcagccatatgcctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57506 - RNA, 286 nt, synthetic construct
  source 1..286: mol_type = other RNA
cgctcttccgcgtctcttaagcttgcgcggcagccatatgggcatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57507 - RNA, 286 nt, synthetic construct
  source 1..286: mol_type = other RNA
cgctcttccgcgtctcttaagcttgcgcggcagccatatgggccctgagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57508 - RNA, 286 nt, synthetic construct
  source 1..286: mol_type = other RNA
cgctcttccgcgtctcttaagcttgcgcggcagccatatgggccctatgatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57509 - RNA, 286 nt, synthetic construct
  source 1..286: mol_type = other RNA
cgctcttccgcgtctcttaagcttgcgcggcagccatatgggccctatggagtacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57510 - RNA, 286 nt, synthetic construct
  source 1..286: mol_type = other RNA
cgctcttccgcgtctcttaagcttgcgcggcagccatatgggccctatggagataaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57511 - RNA, 286 nt, synthetic construct
  source 1..286: mol_type = other RNA
cgctcttccgcgtctcttaagcttgcgcggcagccatatgggccctatggagatatacacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57512 - RNA, 286 nt, synthetic construct
  source 1..286: mol_type = other RNA
cgctcttccgcgtctcttaagcttgcgcggcagccatatgggccctatggagatatacaaggtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57513 - RNA, 286 nt, synthetic construct
  source 1..286: mol_type = other RNA
cgctcttccgcgtctcttaagcttgcgcggcagccatatgggccctatggagatatacaagacatctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57514 - RNA, 286 nt, synthetic construct
  source 1..286: mol_type = other RNA
cgctcttccgcgtctcttaagcttgcgcggcagccatatgggccctatggagatatacaagacagtggcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57515 - RNA, 286 nt, synthetic construct
  source 1..286: mol_type = other RNA
cgctcttccgcgtctcttaagcttgcgcggcagccatatgggccctatggagatatacaagacagtgtcttggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57516 - RNA, 286 nt, synthetic construct
  source 1..286: mol_type = other RNA
cgctcttccgcgtctcttaagcttgcgcggcagccatatgggccctatggagatatacaagacagtgtctgcaaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57517 - RNA, 286 nt, synthetic construct
  source 1..286: mol_type = other RNA
cgctcttccgcgtctcttaagcttgcgcggcagccatatgggccctatggagatatacaagacagtgtctgcatggagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57518 - RNA, 286 nt, synthetic construct
  source 1..286: mol_type = other RNA
cgctcttccgcgtctcttaagcttgcgcggcagccatatgggccctatggagatatacaagacagtgtctgcatggaagcagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57519 - RNA, 286 nt, synthetic construct
  source 1..286: mol_type = other RNA
cgctcttccgcgtctcttaagcttgcgcggcagccatatgggccctatggagatatacaagacagtgtctgcatggaagagaccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57520 - RNA, 286 nt, synthetic construct
  source 1..286: mol_type = other RNA
cgctcttccgcgtctcttaagcttgcgcggcagccatatgggccctatggagatatacaagacagtgtctgcatggaagagacaggtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57521 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccacgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57522 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57523 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcggctgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57524 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtaagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57525 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57526 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57527 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57528 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57529 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57530 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57531 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57532 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacgtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57533 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaagctaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57534 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57535 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57536 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagttgggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57537 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtggcttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57538 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgttcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57539 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttggaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57540 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcgaaagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57541 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttgagcggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57542 - RNA, 286 nt, synthetic construct
  source 1..286: mol_type = other RNA
cgctcttccgcgtctcttaagcttgcgcggcagccatatgggccctatggagatatacaagacagtgtctgcatggaagagacagccagtgcgggtactgagcctcttcagaaacatcgacaaggtactaaagagtttgggcttcttggaaggttctggttctgggggaggaacgctgaagtacgtggaagatgtcacaaatgtcgtgaggagggacgtggagaaatggggcccctttgacctggtgtacggctcgacgcagcccctagggagacgtcggaagagc

SEQ ID NO: 57543 - RNA, 289 nt, synthetic construct; identical to SEQ ID NO: 54695
  source 1..289: mol_type = other RNA

SEQ ID NO: 57544 - RNA, 155 nt, synthetic construct
  source 1..155: mol_type = other RNA
actggcgcttttatctgattactttgagagccatcaccagcgactatgtcgtagtgggtaaagctgcactatgggcgcagcacctgaggatcacccaggtgctgacggtacaggccacctgaggatcacccaggtggtatagtgcagcatcaaag

SEQ ID NO: 57545 - RNA, 155 nt, synthetic construct
  source 1..155: mol_type = other RNA
actggcgcttttatctgattactttgagagccatcaccagcgactatgtcgtagtgggtaaagctgcactatgggcgcagcgcatgaggatcacccatgcgctgacggtacaggccgcatgaggatcacccatgcggtatagtgcagcatcaaag

SEQ ID NO: 57546 - RNA, 155 nt, synthetic construct
  source 1..155: mol_type = other RNA
actggcgcttttatctgattactttgagagccatcaccagcgactatgtcgtagtgggtaaagctgcactatgggcgcagcgcctgaggatcacccaggcgctgacggtacaggccgcctgaggatcacccaggcggtatagtgcagcatcaaag

SEQ ID NO: 57547 - RNA, 155 nt, synthetic construct
  source 1..155: mol_type = other RNA
actggcgcttttatctgattactttgagagccatcaccagcgactatgtcgtagtgggtaaagctgcactatgggcgcagcgcctgagcatcagccaggcgctgacggtacaggccgcctgagcatcagccaggcggtatagtgcagcatcaaag

SEQ ID NO: 57548 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgagcatcagccatgtgctgacggtacaggccacatgagcatcagccatgtggtatagtgcagcatcaaag

SEQ ID NO: 57549 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgagtatcaaccatgtgctgacggtacaggccacatgagtatcaaccatgtggtatagtgcagcatcaaag

SEQ ID NO: 57550 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgagaatcagccatgtgctgacggtacaggccacatgagaatcagccatgtggtatagtgcagcatcaaag

SEQ ID NO: 57551 - RNA, 155 nt, synthetic construct
  source 1..155: mol_type = other RNA
actggcgcttttatctgattactttgagagccatcaccagcgactatgtcgtagtgggtaaagctgcactatgggcgcagcccttgaggatcacccatgtgctgacggtacaggccccttgaggatcacccatgtggtatagtgcagcatcaaag

SEQ ID NO: 57552 - RNA, 155 nt, synthetic construct
  source 1..155: mol_type = other RNA
actggcgcttttatctgattactttgagagccatcaccagcgactatgtcgtagtgggtaaagctgcactatgggcgcagcacttgaggatcacccatgtgctgacggtacaggccacttgaggatcacccatgtggtatagtgcagcatcaaag

SEQ ID NO: 57553 - RNA, 155 nt, synthetic construct
  source 1..155: mol_type = other RNA
actggcgcttttatctgattactttgagagccatcaccagcgactatgtcgtagtgggtaaagctgcactatgggcgcagcacctgaggatcacccatgtgctgacggtacaggccacctgaggatcacccatgtggtatagtgcagcatcaaag

SEQ ID NO: 57554 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggatcacctatgtgctgacggtacaggccacatgaggatcacctatgtggtatagtgcagcatcaaag

SEQ ID NO: 57555 - RNA, 155 nt, synthetic construct
  source 1..155: mol_type = other RNA
actggcgcttttatctgattactttgagagccatcaccagcgactatgtcgtagtgggtaaagctgcactatgggcgcagcacattaggatcaccaatgtgctgacggtacaggccacattaggatcaccaatgtggtatagtgcagcatcaaag

SEQ ID NO: 57556 - RNA, 155 nt, synthetic construct
  source 1..155: mol_type = other RNA
actggcgcttttatctgattactttgagagccatcaccagcgactatgtcgtagtgggtaaagctgcactatgggcgcagcacattaggatcaccgatgtgctgacggtacaggccacattaggatcaccgatgtggtatagtgcagcatcaaag

SEQ ID NO: 57557 - RNA, 155 nt, synthetic construct
  source 1..155: mol_type = other RNA
actggcgcttttatctgattactttgagagccatcaccagcgactatgtcgtagtgggtaaagctgcactatgggcgcagcacattaggatcacctatgtgctgacggtacaggccacattaggatcacctatgtggtatagtgcagcatcaaag

SEQ ID NO: 57558 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggattacccatgtgctgacggtacaggccacatgaggattacccatgtggtatagtgcagcatcaaag

SEQ ID NO: 57559 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggataacccatgtgctgacggtacaggccacatgaggataacccatgtggtatagtgcagcatcaaag

SEQ ID NO: 57560 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggatgacccatgtgctgacggtacaggccacatgaggatgacccatgtggtatagtgcagcatcaaag

SEQ ID NO: 57561 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggaccacccatgtgctgacggtacaggccacatgaggaccacccatgtggtatagtgcagcatcaaag

SEQ ID NO: 57562 - RNA, 155 nt, synthetic construct
  source 1..155: mol_type = other RNA
actggcgcttttatctgattactttgagagccatcaccagcgactatgtcgtagtgggtaaagctgcactatgggcgcagcagatgaggatcacccatgggctgacggtacaggccagatgaggatcacccatggggtatagtgcagcatcaaag

SEQ ID NO: 57563 - RNA, 155 nt, synthetic construct
  source 1..155: mol_type = other RNA
actggcgcttttatctgattactttgagagccatcaccagcgactatgtcgtagtgggtaaagctgcactatgggcgcagcacatggggatcacccatgtgctgacggtacaggccacatggggatcacccatgtggtatagtgcagcatcaaag

SEQ ID NO: 57564 - RNA, 155 nt, synthetic construct
  source 1..155: mol_type = other RNA
actggcgcttttatctgattactttgagagccatcaccagcgactatgtcgtagtgggtaaagctgcactatgggcgcagcacatgaggatcacccatgtgctgacggtacaggccacatgaggatcacccatgtggtatagtgcagcatcaaag

SEQ ID NO: 57565 - RNA, 96 nt, synthetic construct
  source 1..96: mol_type = other RNA
actggcgcttttatctgattactttgagagccatcaccagcgactatgtcgtagtgggtaaagctcacctgaggatcacccaggtgagcatcaaag

SEQ ID NO: 57566 - RNA, 96 nt, synthetic construct
  source 1..96: mol_type = other RNA
actggcgcttttatctgattactttgagagccatcaccagcgactatgtcgtagtgggtaaagctcgcatgaggatcacccatgcgagcatcaaag

SEQ ID NO: 57567 - RNA, 96 nt, synthetic construct
  source 1..96: mol_type = other RNA
actggcgcttttatctgattactttgagagccatcaccagcgactatgtcgtagtgggtaaagctcgcctgaggatcacccaggcgagcatcaaag

SEQ ID NO: 57568 - RNA, 96 nt, synthetic construct
  source 1..96: mol_type = other RNA
actggcgcttttatctgattactttgagagccatcaccagcgactatgtcgtagtgggtaaagctcgcctgagcatcagccaggcgagcatcaaag

SEQ ID NO: 57569 - RNA, 96 nt, synthetic construct
  source 1..96: mol_type = other RNA
actggcgcttttatctgattactttgagagccatcaccagcgactatgtcgtagtgggtaaagctcacatgagcatcagccatgtgagcatcaaag

SEQ ID NO: 57570 - RNA, 96 nt, synthetic construct
  source 1..96: mol_type = other RNA
actggcgcttttatctgattactttgagagccatcaccagcgactatgtcgtagtgggtaaagctcacatgagtatcaaccatgtgagcatcaaag

SEQ ID NO: 57571 - RNA, 96 nt, synthetic construct
  source 1..96: mol_type = other RNA
actggcgcttttatctgattactttgagagccatcaccagcgactatgtcgtagtgggtaaagctcacatgagaatcagccatgtgagcatcaaag

SEQ ID NO: 57572 - RNA, 96 nt, synthetic construct
  source 1..96: mol_type = other RNA
actggcgcttttatctgattactttgagagccatcaccagcgactatgtcgtagtgggtaaagctcccttgaggatcacccatgtgagcatcaaag

SEQ ID NO: 57573 - RNA, 96 nt, synthetic construct
  source 1..96: mol_type = other RNA
actggcgcttttatctgattactttgagagccatcaccagcgactatgtcgtagtgggtaaagctcacttgaggatcacccatgtgagcatcaaag

SEQ ID NO: 57574 - RNA, 96 nt, synthetic construct
  source 1..96: mol_type = other RNA
actggcgcttttatctgattactttgagagccatcaccagcgactatgtcgtagtgggtaaagctcacctgaggatcacccatgtgagcatcaaag

SEQ ID NO: 57575 - RNA, 96 nt, synthetic construct
  source 1..96: mol_type = other RNA
actggcgcttttatctgattactttgagagccatcaccagcgactatgtcgtagtgggtaaagctcacatgaggatcacctatgtgagcatcaaag

SEQ ID NO: 57576 - RNA, 96 nt, synthetic construct
  source 1..96: mol_type = other RNA
actggcgcttttatctgattactttgagagccatcaccagcgactatgtcgtagtgggtaaagctcacattaggatcaccaatgtgagcatcaaag

SEQ ID NO: 57577 - RNA, 96 nt, synthetic construct
  source 1..96: mol_type = other RNA
actggcgcttttatctgattactttgagagccatcaccagcgactatgtcgtagtgggtaaagctcacattaggatcaccgatgtgagcatcaaag

SEQ ID NO: 57578 - RNA, 96 nt, synthetic construct
  source 1..96: mol_type = other RNA
actggcgcttttatctgattactttgagagccatcaccagcgactatgtcgtagtgggtaaagctcacattaggatcacctatgtgagcatcaaag

SEQ ID NO: 57579 - RNA, 96 nt, synthetic construct
  source 1..96: mol_type = other RNA
actggcgcttttatctgattactttgagagccatcaccagcgactatgtcgtagtgggtaaagctcacatgaggattacccatgtgagcatcaaag

SEQ ID NO: 57580 - RNA, 96 nt, synthetic construct
  source 1..96: mol_type = other RNA
actggcgcttttatctgattactttgagagccatcaccagcgactatgtcgtagtgggtaaagctcacatgaggataacccatgtgagcatcaaag

SEQ ID NO: 57581 - RNA, 96 nt, synthetic construct
  source 1..96: mol_type = other RNA
actggcgcttttatctgattactttgagagccatcaccagcgactatgtcgtagtgggtaaagctcacatgaggatgacccatgtgagcatcaaag

SEQ ID NO: 57582 - RNA, 96 nt, synthetic construct
  source 1..96: mol_type = other RNA
actggcgcttttatctgattactttgagagccatcaccagcgactatgtcgtagtgggtaaagctcacatgaggaccacccatgtgagcatcaaag

SEQ ID NO: 57583 - RNA, 96 nt, synthetic construct
  source 1..96: mol_type = other RNA
actggcgcttttatctgattactttgagagccatcaccagcgactatgtcgtagtgggtaaagctcagatgaggatcacccatgggagcatcaaag

SEQ ID NO: 57584 - RNA, 96 nt, synthetic construct
  source 1..96: mol_type = other RNA
actggcgcttttatctgattactttgagagccatcaccagcgactatgtcgtagtgggtaaagctcacatggggatcacccatgtgagcatcaaag

SEQ ID NO: 57585 - RNA, 96 nt, synthetic construct
  source 1..96: mol_type = other RNA
actggcgcttctatctgattactctgagcgccatcaccagcgactatgtcgtagtgggtaaagctcacatgaggatcacccatgtgagcatcagag

SEQ ID NO: 57586 - RNA, 145 nt, synthetic construct
  source 1..145: mol_type = other RNA
actggcgcttctatctgattactctgagcgccatcaccagcgactatgtcgtagtgggtaaagctgcactatgggcgcagcgtcaatgacgctgacggtacaggccacatgaggatcacccatgtggtatagtgcagcatcagag

SEQ ID NO: 57587 - RNA, 155 nt, synthetic construct
  source 1..155: mol_type = other RNA
actggcgcttctatctgattactctgagcgccatcaccagcgactatgtcgtagtgggtaaagctgcactatgggcgcagctcatgaggatcacccatgagctgacggtacaggccacatgaggatcacccatgtggtatagtgcagcatcagag

SEQ ID NO: 57588 - RNA, 159 nt, synthetic construct
  source 1..159: mol_type = other RNA
actggcgcttctatctgattactctgagcgccatcaccagcgactatgtcgtagtgggtaaagctgcactatgggcgcagacatggcagtcgtaacgacgcgggtctgacggtacaggccacatgaggatcacccatgtggtatagtgcagcatcagag

SEQ ID NO: 57589 - RNA, 145 nt, synthetic construct
  source 1..145: mol_type = other RNA
actggcgcttttatctgattactttgagagccatcaccagcgactatgtcgtagtgggtaaagctgcactatggggccacatgaggatcacccatgtggtgtacagcgcagcgtcaatgacgctgacgatagtgcagcatcaaag

SEQ ID NO: 57590 - DNA, 216 bp, synthetic construct
  source 1..216: mol_type = other DNA
atggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagccc

SEQ ID NO: 57591 - DNA, 300 bp, synthetic construct
  source 1..300: mol_type = other DNA
atgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctc

SEQ ID NO: 57592 - DNA, 906 bp, synthetic construct
  source 1..906: mol_type = other DNA
atgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtg

SEQ ID NO: 57593 - protein, 302 aa, synthetic construct
MNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 57594 - DNA, 507 bp, synthetic construct
  source 1..507: mol_type = other DNA
acgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 57595 - protein, 169 aa, synthetic construct
TLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 57596 - DNA, 2931 bp, synthetic construct
  source 1..2931: mol_type = other DNA
caagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtg

SEQ ID NO: 57597 - DNA, 11190 bp, synthetic construct
  source 1..11190: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57598 - DNA, 11106 bp, synthetic construct
  source 1..11106: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57599 - DNA, 11163 bp, synthetic construct
  source 1..11163: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57600 - DNA, 11079 bp, synthetic construct
  source 1..11079: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57601 - DNA, 11163 bp, synthetic construct
  source 1..11163: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57602 - DNA, 11079 bp, synthetic construct
  source 1..11079: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57603 - DNA, 11157 bp, synthetic construct
  source 1..11157: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57604 - DNA, 11073 bp, synthetic construct
  source 1..11073: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57605 - DNA, 11151 bp, synthetic construct
  source 1..11151: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57606 - DNA, 11067 bp, synthetic construct
  source 1..11067: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagggccgagatgtctcgctccgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57607 - RNA, 20 nt, synthetic construct
  source 1..20: mol_type = other RNA
ggccgagatgtctcgctccg

SEQ ID NO: 57608 - RNA, 20 nt, synthetic construct
  source 1..20: mol_type = other RNA
cgcgagcacagctaaggcca

SEQ ID NO: 57609 - RNA, 20 nt, synthetic construct
  source 1..20: mol_type = other RNA
cgagacgtaattacgtctcg

SEQ ID NO: 57610 - DNA, 216 bp, synthetic construct; identical to SEQ ID NO: 57590
  source 1..216: mol_type = other DNA

SEQ ID NO: 57611 - protein, 72 aa, synthetic construct; identical to SEQ ID NO: 338

SEQ ID NO: 57612 - DNA, 300 bp, synthetic construct; identical to SEQ ID NO: 57591
  source 1..300: mol_type = other DNA

SEQ ID NO: 57613 - protein, 100 aa, synthetic construct; identical to SEQ ID NO: 337

SEQ ID NO: 57614 - DNA, 906 bp, synthetic construct; identical to SEQ ID NO: 57592
  source 1..906: mol_type = other DNA

SEQ ID NO: 57615 - protein, 302 aa, synthetic construct; identical to SEQ ID NO: 57593

SEQ ID NO: 57616 - DNA, 645 bp, synthetic construct
  source 1..645: mol_type = other DNA
atgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 57617 - protein, 215 aa, synthetic construct
MGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 57618 - DNA, 2931 bp, synthetic construct; identical to SEQ ID NO: 57596
  source 1..2931: mol_type = other DNA

SEQ ID NO: 57619 - protein, 977 aa, synthetic construct; identical to SEQ ID NO: 18

SEQ ID NO: 57620 - DNA, 240 bp, synthetic construct
  source 1..240: mol_type = other DNA
ggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgag

SEQ ID NO: 57621 - protein, 80 aa, synthetic construct
GGPSSGAPPPSGGSPAGSPTSTEEGTSESATPESGPGTSTEPSEGSAPGSPAGSPTSTEEGTSTEPSEGSAPGTSTEPSE

SEQ ID NO: 57622 - DNA, 81 bp, synthetic construct
  source 1..81: mol_type = other DNA
tctagcggcaatagtaacgctaacagccgcgggccgagcttcagcagcggcctggtgccgttaagcttgcgcggcagccat

SEQ ID NO: 57623 - protein, 27 aa, synthetic construct
SSGNSNANSRGPSFSSGLVPLSLRGSH

SEQ ID NO: 57624 - DNA, 21 bp, synthetic construct
  source 1..21: mol_type = other DNA
ggcggttccggcggaggaagc

SEQ ID NO: 57625 - DNA, 21 bp, synthetic construct
  source 1..21: mol_type = other DNA
ggcggttccggcggaggttcc

SEQ ID NO: 57626 - protein, 7 aa, synthetic construct
GGSGGGS

SEQ ID NO: 57627 - DNA, 21 bp, synthetic construct
  source 1..21: mol_type = other DNA
ggatcaggctctggaggtgga

SEQ ID NO: 57628 - protein, 7 aa, synthetic construct
GSGSGGG

SEQ ID NO: 57629 - DNA, 21 bp, synthetic construct
  source 1..21: mol_type = other DNA
ccaaagaagaagcggaaggtc

SEQ ID NO: 57630 - DNA, 21 bp, synthetic construct
  source 1..21: mol_type = other DNA
ccaaaaaagaagagaaaggta

SEQ ID NO: 57631 - protein, 7 aa, synthetic construct
PKKKRKV

SEQ ID NO: 57632 - DNA, 24 bp, synthetic construct
  source 1..24: mol_type = other DNA
gattacaaagatgacgatgacaaa

SEQ ID NO: 57633 - protein, 8 aa, synthetic construct
DYKDDDDK

SEQ ID NO: 57634 - DNA, 11190 bp, synthetic construct
  source 1..11190: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57635 - DNA, 11106 bp, synthetic construct
  source 1..11106: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57636 - DNA, 11163 bp, synthetic construct
  source 1..11163: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57637 - DNA, 11079 bp, synthetic construct
  source 1..11079: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57638 - DNA, 11163 bp, synthetic construct
  source 1..11163: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57639 - DNA, 11079 bp, synthetic construct
  source 1..11079: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57640 - DNA, 11157 bp, synthetic construct
  source 1..11157: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57641 - DNA, 11073 bp, synthetic construct
  source 1..11073: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57642 - DNA, 11151 bp, synthetic construct
  source 1..11151: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57643 - DNA, 11067 bp, synthetic construct
  source 1..11067: mol_type = other DNA
tggaagggctaattcactcccaaagaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagtggcgcccgaacagggacttgaaagcgaaagggaaaccagaggagctctctcgacgcaggactcggcttgctgaagcgcgcacggcaagaggcgaggggcggcgactggtgagtacgccaaaaattttgactagcggaggctagaaggagagagatgggtgcgagagcgtcagtattaagcgggggagaattagatcgcgatgggaaaaaattcggttaaggccagggggaaagaaaaaatataaattaaaacatatagtatgggcaagcagggagctagaacgattcgcagttaatcctggcctgttagaaacatcagaaggctgtagacaaatactgggacagctacaaccatcccttcagacaggatcagaagaacttagatcattatataatacagtagcaaccctctattgtgtgcatcaaaggatagagataaaagacaccaaggaagctttagacaagatagaggaacagcaaaacaaaagtaagaccaccgcacagcaagcggccggccgctgatcttcagacctggaggaggagatatgagggacaattggagaagtgaattatataaatataaagtagtaaaaattgaaccattaggagtagcacccaccaaggcaaagagaagagtggtgcagagagaaaaaagagcagtgggaataggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcctggggatttggggttgctctggaaaactcatttgcaccactgctgtgccttggaatgctagttggagtaataaatctctggaacagatttggaatcacacgacctggatggagtgggacagagaaattaacaattacacaagcttaatacactccttaattgaagaatcgcaaaaccagcaagaaaagaatgaacaagaattattggaattagataaatgggcaagtttgtggaattggtttaacataacaaattggctgtggtatataaaattattcataatgatagtaggaggcttggtaggtttaagaatagtttttgctgtactttctatagtgaatagagttaggcagggatattcaccattatcgtttcagacccacctcccaaccccgaggggacccgacaggcccgaaggaatagaagaagaaggtggagagagagacagagacagatccattcgattagtgaacggatctcgacggtatcgcctttaaaagaaaaggggggattggggggtacagtgcaggggaaagaatagtagacataatagcaacagacatacaaactaaagaattacaaaaacaaattacaaaaattcaaaattttcgggttttcgggtttattacagggacagcagagatccagtttgagggcctatttcccatgattccttcatatttgcatatacgatacaaggctgttagagagataattggaattaatttgactgtaaacacaaagatattagtacaaaatacgtgacgtagaaagtaataatttcttgggtagtttgcagttttaaaattatgttttaaaatggactatcatatgcttaccgtaacttgaaagtatttcgatttcttggctttatatatcttgtggaaaggacgaaacaccactggcgcttttatctgattactttgagagccatcaccagcgactatgtcgtagtgggtaaagctccctcttcggagggagcatcaaagcgagacgtaattacgtctcgttttttttgaattcgctagctaggtcttatcgatgaggccctttcgtcttcactcgaggtgcccgtcagtgggcagagcgcacatcgcccacagtccccgagaagttggggggaggggtcggcaattgaaccggtgcctagagaaggtggcgcggggtaaactgggaaagtgatgtcgtgtactggctccgcctttttcccgagggtgggggagaaccgtatataagtgcagtagtcgccgtgaacgttctttttcgcaacgggtttgccgccagaacacaggtaagtgccgtgtgtggttcccgcgggcctggcctctttacgggttatggcccttgcgtgccttgaattacttccacctggctgcagtacgtgattcttgatcccgagcttcgggttggaagtgggtgggagagttcgaggccttgcgcttaaggagccccttcgcctcgtgcttgagttgaggcctggcctgggcgctggggccgccgcgtgcgaatctggtggcaccttcgcgcctgtctcgctgctttcgataagtctctagccatttaaaatttttgatgacctgctgcgacgctttttttctggcaagatagtcttgtaaatgcgggccaagatctgcacactggtatttcggtttttggggccgcgggcggcgacggggcccgtgcgtcccagcgcacatgttcggcgaggcggggcctgcgagcgcggccaccgagaatcggacgggggtagtctcaagctggccggcctgctctggtgcctggcctcgcgccgccgtgtatcgccccgccctgggcggcaaggctggcccggtcggcaccagttgcgtgagcggaaagatggccgcttcccggccctgctgcagggagctcaaaatggaggacgcggcgctcgggagagcgggcgggtgagtcacccacacaaaggaaaagggcctttccgtcctcagccgtcgcttcatgtgactccacggagtaccgggcgccgtccaggcacctcgattagttctcgagcttttggagtacgtcgtctttaggttggggggaggggttttatgcgatggagtttccccacactgagtgggtggagactgaagttaggccagcttggcacttgatgtaattctccttggaatttgccctttttgagtttggatcttggttcattctcaagcctcagacagtggttcaaagtttttttcttccatttcaggtgtcgtgagggtgccaccatggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggtagattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcctgacgggcgcgtctggaacaatcaacctctggattacaaaatttgtgaaagattgactggtattcttaactatgttgctccttttacgctatgtggatacgctgctttaatgcctttgtatcatgctattgcttcccgtatggctttcattttctcctccttgtataaatcctggttgctgtctctttatgaggagttgtggcccgttgtcaggcaacgtggcgtggtgtgcactgtgtttgctgacgcaacccccactggttggggcattgccaccacctgtcagctcctttccgggactttcgctttccccctccctattgccacggcggaactcatcgccgcctgccttgcccgctgctggacaggggctcggctgttgggcactgacaattccgtggtgttgtcggggaagctgacgtcctttccatggctgctcgcctgtgttgccacctggattctgcgcgggacgtccttctgctacgtcccttcggccctcaatccagcggaccttccttcccgcggcctgctgccggctctgcggcctcttccgcgtcttcgccttcgccctcagacgagtcggatctccctttgggccgcctccccgcctggaattaattctgcagtcgagacctagaaaaacatggagcaatcacaagtagcaatacagcagctaccaatgctgattgtgcctggctagaagcacaagaggaggaggaggtgggttttccagtcacacctcaggtacctttaagaccaatgacttacaaggcagctgtagatcttagccactttttaaaagaaaagaggggacctggaagggctaattcactcccaacgaagacaagatatccttgatctgtggatctaccacacacaaggctacttccctgattagcagaactacacaccagggccaggggtcagatatccactgacctttggatggtgctacaagctagtaccagttgagccagataaggtagaagaggccaataaaggagagaacaccagcttgttacaccctgtgagcctgcatgggatggatgacccggagagagaagtgttagagtggaggtttgacagccgcctagcatttcatcacgtggcccgagagctgcatccggagtacttcaagaactgctgatatcgagcttgctacaagggactttccgctggggactttccagggaggcgtggcctgggcgggactggggagtggcgagccctcagatcctgcatataagcagctgctttttgcctgtactgggtctctctggttagaccagatctgagcctgggagctctctggctaactagggaacccactgcttaagcctcaataaagcttgccttgagtgcttcaagtagtgtgtgcccgtctgttgtgtgactctggtaactagagatccctcagacccttttagtcagtgtggaaaatctctagcagt

SEQ ID NO: 57644 - RNA, 20 nt, synthetic construct
  source 1..20: mol_type = other RNA
ggccgagatgtctcgctccg

SEQ ID NO: 57645 - RNA, 20 nt, synthetic construct
  source 1..20: mol_type = other RNA
cgcgagcacagctaaggcca

SEQ ID NO: 57646 - RNA, 20 nt, synthetic construct
  source 1..20: mol_type = other RNA
cgagacgtaattacgtctcg

SEQ ID NO: 57647 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNARRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57648 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQVDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57649 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEGEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57650 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLEHLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57651 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQICAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57652 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57653 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFGGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57654 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKLVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57655 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGQFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57656 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVSWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57657 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLREKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57658 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTTYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57659 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEANRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57660 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEELRRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57661 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDERCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57662 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57663 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRQKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57664 - protein, 978 aa, synthetic construct
QEIKRLNKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57665 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLDAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57666 - protein, 976 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57667 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYVGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57668 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINGEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57669 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRFASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57670 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWYTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57671 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVPCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57672 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQTIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57673 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPCQEKFVCLNCGFETHADEQAALNIARSWLFLRSQEYKKYQTNKTTGNTDKRAFVETWQSFYRKKLKEVWKPAV

SEQ ID NO: 57674 - protein, 979 aa, synthetic construct
QEIKRINKIRRRLVKDSNTKKAGKTGPMKTLLVRVMTPDLRERLENLPRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57675 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEGLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57676 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57677 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTISKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57678 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTKSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57679 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKQLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57680 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYYSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57681 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAKYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57682 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLASKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57683 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57684 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57685 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTWITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57686 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKHTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57687 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKPCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57688 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57689 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57690 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLFAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57691 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKNTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57692 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGPTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57693 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTWLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57694 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57695 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57696 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSVNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57697 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTPKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57698 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWPLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57699 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCMSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57700 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLARYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57701 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYFSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57702 - protein, 977 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57703 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSQTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57704 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYNGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57705 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLHSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57706 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKVYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57707 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLQAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57708 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGPLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57709 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKRTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57710 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCWGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57711 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLANYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57712 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNSGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57713 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLSQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57714 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYRLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57715 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKRAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57716 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKDAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57717 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIQLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57718 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYMSGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57719 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAIYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57720 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDVRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57721 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDREKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57722 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEMFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57723 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKQNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57724 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVIMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57725 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVNDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57726 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSGKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57727 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRMLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57728 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRQGEALSLLKKRFSHRPVQEKFVCLNCGFETHADEQAALNIARSWLFLRSQEYKKYQTNKTTGNTDKRAFVETWQSFYRKKLKEVWKPAV

SEQ ID NO: 57729 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCEFETHADEQAALNIARSWLFLRSQEYKKYQTNKTTGNTDKRAFVETWQSFYRKKLKEVWKPAV

SEQ ID NO: 57730 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTSTGNTDKRAFVETWQSFYRKKLKEVWKPAV

SEQ ID NO: 57731 - protein, 979 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVDRGENIPAVIALTDPEGCPLSRFKDSLGNPTHILRIGESYKEKQRTIQAKKEVEQRRAGGYSRKYASKAKNLADDMVRNTARDLLYYAVTQDAMLIFENLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHADEQAALNIARSWLFLRSQEYKKYQTNKTTGKNTDKRAFVETWQSFYRKKLKEVWKPAV

SEQ ID NO: 57732 - protein, 977 aa, synthetic construct; identical to SEQ ID NO: 18

SEQ ID NO: 57733 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 57734 - protein, 972 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKE

SEQ ID NO: 57735 - protein, 979 aa, synthetic construct
QEIKRINKIRRRLVKDSNTKKAGKTRGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 57736 - RNA, 31 nt, synthetic construct
  source 1..31: mol_type = other RNA
tgggcgcagcgtcaatgacgctgacggtaca

SEQ ID NO: 57737 - RNA, 66 nt, synthetic construct
  source 1..66: mol_type = other RNA
gcactatgggcgcagcgtcaatgacgctgacggtacaggccagacaattattgtctggtatagtgc

SEQ ID NO: 57738 - RNA, 167 nt, synthetic construct
  source 1..167: mol_type = other RNA
caggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctg

SEQ ID NO: 57739 - RNA, 15 nt, synthetic construct
  source 1..15: mol_type = other RNA
gctgacggtacaggc

SEQ ID NO: 57740 - RNA, 234 nt, synthetic construct
  source 1..234: mol_type = other RNA
aggagctttgttccttgggttcttgggagcagcaggaagcactatgggcgcagcgtcaatgacgctgacggtacaggccagacaattattgtctggtatagtgcagcagcagaacaatttgctgagggctattgaggcgcaacagcatctgttgcaactcacagtctggggcatcaagcagctccaggcaagaatcctggctgtggaaagatacctaaaggatcaacagctcct

SEQ ID NO: 57741 - RNA, 28 nt, synthetic construct
  source 1..28: mol_type = other RNA
ggctcgtgtagctcattagctccgagcc

SEQ ID NO: 57742 - RNA, 30 nt, synthetic construct
  source 1..30: mol_type = other RNA
ccgtgtgcatccgcagtgtcggatccacgg

SEQ ID NO: 57743 - RNA, 28 nt, synthetic construct
  source 1..28: mol_type = other RNA
ggctcgtgtagctcattagctccgagcc

SEQ ID NO: 57744 - RNA, 23 nt, synthetic construct
  source 1..23: mol_type = other RNA
aaaacataaggaaaacctatgtt

SEQ ID NO: 57745 - RNA, 15 nt, synthetic construct
  source 1..15: mol_type = other RNA
gccctgaagaagggc

SEQ ID NO: 57746 - protein, 81 aa, Pan paniscus; identical to SEQ ID NO: 381

SEQ ID NO: 57747 - protein, 81 aa, Colobus angolensis palliatus; identical to SEQ ID NO: 11450

SEQ ID NO: 57748 - protein, 81 aa, Colobus angolensis palliatus; identical to SEQ ID NO: 12067

SEQ ID NO: 57749 - protein, 81 aa, Mandrillus leucophaeus; identical to SEQ ID NO: 12148

SEQ ID NO: 57750 - protein, 81 aa, Bos indicus x Bos taurus; identical to SEQ ID NO: 18477

SEQ ID NO: 57751 - protein, 81 aa, Felis catus; identical to SEQ ID NO: 18878

SEQ ID NO: 57752 - protein, 81 aa, Physeter macrocephalus; identical to SEQ ID NO: 19377

SEQ ID NO: 57753 - protein, 81 aa, Callorhinus ursinus; identical to SEQ ID NO: 20923

SEQ ID NO: 57754 - protein, 81 aa, Chlorocebus sabaeus; identical to SEQ ID NO: 21624

SEQ ID NO: 57755 - protein, 81 aa, Ophiophagus hannah; identical to SEQ ID NO: 27868

SEQ ID NO: 57756 - protein, 81 aa, Pan paniscus; identical to SEQ ID NO: 1109

SEQ ID NO: 57757 - protein, 81 aa, Pan paniscus; identical to SEQ ID NO: 1769

SEQ ID NO: 57758 - protein, 81 aa, Pongo abelii; identical to SEQ ID NO: 3499

SEQ ID NO: 57759 - protein, 81 aa, Hylobates moloch; identical to SEQ ID NO: 4061

SEQ ID NO: 57760 - protein, 81 aa, Callithrix jacchus; identical to SEQ ID NO: 5806

SEQ ID NO: 57761 - protein, 81 aa, Callithrix jacchus; identical to SEQ ID NO: 5925

SEQ ID NO: 57762 - protein, 81 aa, Callithrix jacchus; identical to SEQ ID NO: 6087

SEQ ID NO: 57763 - protein, 81 aa, Callithrix jacchus; identical to SEQ ID NO: 6185

SEQ ID NO: 57764 - protein, 81 aa, Aotus trivirgatus; identical to SEQ ID NO: 6409

SEQ ID NO: 57765 - protein, 81 aa, Aotus trivirgatus; identical to SEQ ID NO: 6582

SEQ ID NO: 57766 - protein, 81 aa, Saimiri boliviensis boliviensis; identical to SEQ ID NO: 7367

SEQ ID NO: 57767 - protein, 81 aa, Alligator sinensis; identical to SEQ ID NO: 7564

SEQ ID NO: 57768 - protein, 81 aa, Pantherophis guttatus; identical to SEQ ID NO: 7921

SEQ ID NO: 57769 - protein, 81 aa, Xenopus laevis; identical to SEQ ID NO: 7926

SEQ ID NO: 57770 - protein, 81 aa, Microcaecilia unicolor; identical to SEQ ID NO: 8374

SEQ ID NO: 57771 - protein, 81 aa, Columba livia; identical to SEQ ID NO: 8813

SEQ ID NO: 57772 - protein, 81 aa, Mus caroli; identical to SEQ ID NO: 9622

SEQ ID NO: 57773 - protein, 81 aa, Marmota monax; identical to SEQ ID NO: 9909

SEQ ID NO: 57774 - protein, 81 aa, Mesocricetus auratus; identical to SEQ ID NO: 9972

SEQ ID NO: 57775 - protein, 81 aa, Peromyscus maniculatus bairdii; identical to SEQ ID NO: 10233

SEQ ID NO: 57776 - protein, 81 aa, Peromyscus maniculatus bairdii; identical to SEQ ID NO: 10450

SEQ ID NO: 57777 - protein, 81 aa, Mus musculus; identical to SEQ ID NO: 10657

SEQ ID NO: 57778 - protein, 81 aa, Octodon degus; identical to SEQ ID NO: 11079

SEQ ID NO: 57779 - protein, 81 aa, Rattus norvegicus; identical to SEQ ID NO: 11242

SEQ ID NO: 57780 - protein, 81 aa, Dipodomys ordii; identical to SEQ ID NO: 11396

SEQ ID NO: 57781 - protein, 81 aa, Colobus angolensis palliatus; identical to SEQ ID NO: 11696

SEQ ID NO: 57782 - protein, 81 aa, Chlorocebus sabaeus; identical to SEQ ID NO: 12467

SEQ ID NO: 57783 - protein, 81 aa, Capra hircus; identical to SEQ ID NO: 12505

SEQ ID NO: 57784 - protein, 81 aa, Bos mutus; identical to SEQ ID NO: 12605

SEQ ID NO: 57785 - protein, 81 aa, Nomascus leucogenys; identical to SEQ ID NO: 12802

SEQ ID NO: 57786 - protein, 81 aa, Sus scrofa; identical to SEQ ID NO: 13411

SEQ ID NO: 57787 - protein, 81 aa, Neophocaena asiaeorientalis asiaeorientalis; identical to SEQ ID NO: 13571

SEQ ID NO: 57788 - protein, 81 aa, Macaca fascicularis; identical to SEQ ID NO: 13750

SEQ ID NO: 57789 - protein, 81 aa, Macaca fascicularis; identical to SEQ ID NO: 14450

SEQ ID NO: 57790 - protein, 81 aa, Phascolarctos cinereus; identical to SEQ ID NO: 14587

SEQ ID NO: 57791 - protein, 81 aa, Gorilla gorilla; identical to SEQ ID NO: 14658

SEQ ID NO: 57792 - protein, 81 aa, Acinonyx jubatus; identical to SEQ ID NO: 15778

SEQ ID NO: 57793 - protein, 81 aa, Cebus imitator; identical to SEQ ID NO: 15874

SEQ ID NO: 57794 - protein, 81 aa, Callithrix jacchus; identical to SEQ ID NO: 16245

SEQ ID NO: 57795 - protein, 81 aa, Cebus imitator; identical to SEQ ID NO: 16626

SEQ ID NO: 57796 - protein, 81 aa, Acinonyx jubatus; identical to SEQ ID NO: 17563

SEQ ID NO: 57797 - protein, 81 aa, Lipotes vexillifer; identical to SEQ ID NO: 17807

SEQ ID NO: 57798 - protein, 81 aa, Sapajus apella; identical to SEQ ID NO: 17925

SEQ ID NO: 57799 - protein, 81 aa, Otolemur garnettii; identical to SEQ ID NO: 18436

SEQ ID NO: 57800 - protein, 81 aa, Otolemur garnettii; identical to SEQ ID NO: 18551

SEQ ID NO: 57801 - protein, 81 aa, Pan troglodytes; identical to SEQ ID NO: 19024

SEQ ID NO: 57802 - protein, 81 aa, Monodelphis domestica; identical to SEQ ID NO: 19256

SEQ ID NO: 57803 - protein, 81 aa, Physeter macrocephalus; identical to SEQ ID NO: 19335

SEQ ID NO: 57804 - protein, 81 aa, Aotus trivirgatus; identical to SEQ ID NO: 19682

SEQ ID NO: 57805 - protein, 81 aa, Enhydra lutris kenyoni; identical to SEQ ID NO: 20348

SEQ ID NO: 57806 - protein, 81 aa, Monodelphis domestica; identical to SEQ ID NO: 20579

SEQ ID NO: 57807 - protein, 81 aa, Aotus trivirgatus; identical to SEQ ID NO: 20595

SEQ ID NO: 57808 - protein, 81 aa, Rhinopithecus roxellana; identical to SEQ ID NO: 20940

SEQ ID NO: 57809 - protein, 81 aa, Ursus maritimus; identical to SEQ ID NO: 21011

SEQ ID NO: 57810 - protein, 81 aa, Ovis aries; identical to SEQ ID NO: 21015

SEQ ID NO: 57811 - protein, 81 aa, Callorhinus ursinus; identical to SEQ ID NO: 21068

SEQ ID NO: 57812 - protein, 81 aa, Neovison vison; identical to SEQ ID NO: 22366

SEQ ID NO: 57813 - protein, 81 aa, Pteropus vampyrus; identical to SEQ ID NO: 22436

SEQ ID NO: 57814 - protein, 81 aa, Equus caballus; identical to SEQ ID NO: 22455

SEQ ID NO: 57815 - protein, 81 aa, Lipotes vexillifer; identical to SEQ ID NO: 22722

SEQ ID NO: 57816 - protein, 81 aa, Equus caballus; identical to SEQ ID NO: 22874

SEQ ID NO: 57817 - protein, 81 aa, Zalophus californianus; identical to SEQ ID NO: 23272

SEQ ID NO: 57818 - protein, 81 aa, Pan paniscus; identical to SEQ ID NO: 23389

SEQ ID NO: 57819 - protein, 80 aa, Vicugna pacos; identical to SEQ ID NO: 24513

SEQ ID NO: 57820 - protein, 81 aa, Carlito syrichta; identical to SEQ ID NO: 24842

SEQ ID NO: 57821 - protein, 81 aa, Saimiri boliviensis boliviensis; identical to SEQ ID NO: 25244

SEQ ID NO: 57822 - protein, 81 aa, Lynx pardinus; identical to SEQ ID NO: 25577

SEQ ID NO: 57823 - protein, 81 aa, Myotis brandtii; identical to SEQ ID NO: 25782

SEQ ID NO: 57824 - protein, 80 aa, Ursus maritimus; identical to SEQ ID NO: 26408

SEQ ID NO: 57825 - protein, 81 aa, Sapajus apella; identical to SEQ ID NO: 26498

SEQ ID NO: 57826 - protein, 81 aa, Desmodus rotundus; identical to SEQ ID NO: 26524

SEQ ID NO: 57827 - protein, 81 aa, Geotrypetes seraphini; identical to SEQ ID NO: 27189

SEQ ID NO: 57828 - protein, 81 aa, Geotrypetes seraphini; identical to SEQ ID NO: 27441

SEQ ID NO: 57829 - protein, 81 aa, Meleagris gallopavo; identical to SEQ ID NO: 27851

SEQ ID NO: 57830 - protein, 81 aa, Gopherus agassizii; identical to SEQ ID NO: 28179

SEQ ID NO: 57831 - protein, 81 aa, Octodon degus; identical to SEQ ID NO: 28504

SEQ ID NO: 57832 - protein, 81 aa, Bos mutus; identical to SEQ ID NO: 28625

SEQ ID NO: 57833 - protein, 81 aa, Ailuropoda melanoleuca; identical to SEQ ID NO: 28723

SEQ ID NO: 57834 - protein, 81 aa, Callithrix jacchus; identical to SEQ ID NO: 28930

SEQ ID NO: 57835 - protein, 81 aa, Colinus virginianus; identical to SEQ ID NO: 29759

SEQ ID NO: 57836 - protein, 81 aa, Monodelphis domestica; identical to SEQ ID NO: 29922

SEQ ID NO: 57837 - protein, 84 aa, Peromyscus maniculatus bairdii; identical to SEQ ID NO: 30423

SEQ ID NO: 57838 - protein, 90 aa, Phyllostomus discolor; identical to SEQ ID NO: 31292

SEQ ID NO: 57839 - protein, 87 aa, Physeter macrocephalus; identical to SEQ ID NO: 31780

SEQ ID NO: 57840 - protein, 93 aa, Micrurus lemniscatus lemniscatus; identical to SEQ ID NO: 32762

SEQ ID NO: 57841 - protein, 81 aa, Vicugna pacos; identical to SEQ ID NO: 11989

SEQ ID NO: 57842 - protein, 81 aa, Odobenus rosmarus divergens; identical to SEQ ID NO: 12037

SEQ ID NO: 57843 - protein, 81 aa, Pan paniscus; identical to SEQ ID NO: 980

SEQ ID NO: 57844 - protein, 81 aa, Pan paniscus; identical to SEQ ID NO: 986

SEQ ID NO: 57845 - protein, 81 aa, Pan paniscus; identical to SEQ ID NO: 1022

SEQ ID NO: 57846 - protein, 81 aa, Pan paniscus; identical to SEQ ID NO: 1031

SEQ ID NO: 57847 - protein, 81 aa, Pan paniscus; identical to SEQ ID NO: 1033

SEQ ID NO: 57848 - protein, 81 aa, Pan paniscus; identical to SEQ ID NO: 1102

SEQ ID NO: 57849 - protein, 81 aa, Pan paniscus; identical to SEQ ID NO: 1113

SEQ ID NO: 57850 - protein, 81 aa, Pan paniscus; identical to SEQ ID NO: 1114

SEQ ID NO: 57851 - protein, 81 aa, Pan paniscus; identical to SEQ ID NO: 1123

SEQ ID NO: 57852 - protein, 81 aa, Pan paniscus; identical to SEQ ID NO: 1190

SEQ ID NO: 57853 - protein, 81 aa, Pan paniscus; identical to SEQ ID NO: 367

SEQ ID NO: 57854 - protein, 81 aa, Pan paniscus; identical to SEQ ID NO: 1232

SEQ ID NO: 57855 - protein, 81 aa, Pan paniscus; identical to SEQ ID NO: 1250

SEQ ID NO: 57856 - protein, 81 aa, Pan paniscus; identical to SEQ ID NO: 1270

SEQ ID NO: 57857 - protein, 81 aa, Pan paniscus; identical to SEQ ID NO: 1277

SEQ ID NO: 57858 - protein, 81 aa, Pan paniscus; identical to SEQ ID NO: 1295

SEQ ID NO: 57859 - protein, 81 aa, Pan paniscus; identical to SEQ ID NO: 1306

SEQ ID NO: 57860 - protein, 81 aa, Pan paniscus; identical to SEQ ID NO: 1307

SEQ ID NO: 57861 - protein, 81 aa, Pan paniscus; identical to SEQ ID NO: 1309

SEQ ID NO: 57862 - protein, 81 aa, Pan paniscus; identical to SEQ ID NO: 1339

SEQ ID NO: 57863 - protein, 81 aa, Pan paniscus; identical to SEQ ID NO: 1392

SEQ ID NO: 57864 - protein, 81 aa, Pan paniscus; identical to SEQ ID NO: 1404

SEQ ID NO: 57865 - protein, 81 aa, Pan paniscus; identical to SEQ ID NO: 1509

SEQ ID NO: 57866 - protein, 81 aa, Pan paniscus; identical to SEQ ID NO: 1511

SEQ ID NO: 57867 - protein, 81 aa, Pan paniscus; identical to SEQ ID NO: 1512

SEQ ID NO: 57868 - protein, 81 aa, Pan paniscus; identical to SEQ ID NO: 1517

SEQ ID NO: 57869 - protein, 81 aa, Pan paniscus; identical to SEQ ID NO: 1556

SEQ ID NO: 57870 - protein, 81 aa, Pan paniscus; identical to SEQ ID NO: 1606

SEQ ID NO: 57871 - protein, 81 aa, Pan paniscus; identical to SEQ ID NO: 1619

SEQ ID NO: 57872 - protein, 81 aa, Pan paniscus; identical to SEQ ID NO: 1637

SEQ ID NO: 57873 - protein, 81 aa, Pan paniscus; identical to SEQ ID NO: 1647

SEQ ID NO: 57874 - protein, 81 aa, Pan paniscus; identical to SEQ ID NO: 1649

SEQ ID NO: 57875 - protein, 81 aa, Pan paniscus; identical to SEQ ID NO: 1672

SEQ ID NO: 57876 - protein, 81 aa, Pan paniscus; identical to SEQ ID NO: 1689

SEQ ID NO: 57877 - protein, 81 aa, Pan paniscus; identical to SEQ ID NO: 1690

SEQ ID NO: 57878 - protein, 81 aa, Pan paniscus; identical to SEQ ID NO: 1699

SEQ ID NO: 57879 - protein, 81 aa, Pan paniscus; identical to SEQ ID NO: 1700

SEQ ID NO: 57880 - protein, 81 aa, Pan paniscus; identical to SEQ ID NO: 1776

SEQ ID NO: 57881 - protein, 81 aa, Pan paniscus; identical to SEQ ID NO: 1781

SEQ ID NO: 57882 - protein, 81 aa, Pan paniscus; identical to SEQ ID NO: 1826

SEQ ID NO: 57883 - protein, 81 aa, Pan troglodytes; identical to SEQ ID NO: 1854

SEQ ID NO: 57884 - protein, 81 aa, Pan troglodytes; identical to SEQ ID NO: 1860

SEQ ID NO: 57885 - protein, 81 aa, Pan troglodytes; identical to SEQ ID NO: 1868

SEQ ID NO: 57886 - protein, 81 aa, Pan troglodytes; identical to SEQ ID NO: 1875

SEQ ID NO: 57887 - protein, 81 aa, Pan troglodytes; identical to SEQ ID NO: 1887

SEQ ID NO: 57888 - protein, 81 aa, Pan troglodytes; identical to SEQ ID NO: 1894

SEQ ID NO: 57889 - protein, 81 aa, Pan troglodytes; identical to SEQ ID NO: 1967

SEQ ID NO: 57890 - protein, 81 aa, Pan troglodytes; identical to SEQ ID NO: 2025

SEQ ID NO: 57891 - protein, 81 aa, Pan troglodytes; identical to SEQ ID NO: 2041

SEQ ID NO: 57892 - protein, 81 aa, Pan troglodytes; identical to SEQ ID NO: 2072

SEQ ID NO: 57893 - protein, 81 aa, Pan troglodytes; identical to SEQ ID NO: 2356

SEQ ID NO: 57894 - protein, 81 aa, Pan troglodytes; identical to SEQ ID NO: 2361

SEQ ID NO: 57895 - protein, 81 aa, Pan troglodytes; identical to SEQ ID NO: 2366

SEQ ID NO: 57896 - protein, 81 aa, Gorilla gorilla; identical to SEQ ID NO: 2497

SEQ ID NO: 57897 - protein, 81 aa, Gorilla gorilla; identical to SEQ ID NO: 2500

SEQ ID NO: 57898 - protein, 81 aa, Gorilla gorilla; identical to SEQ ID NO: 2501

SEQ ID NO: 57899 - protein, 81 aa, Gorilla gorilla; identical to SEQ ID NO: 2576

SEQ ID NO: 57900 - protein, 81 aa, Gorilla gorilla; identical to SEQ ID NO: 2642

SEQ ID NO: 57901 - protein, 81 aa, Gorilla gorilla; identical to SEQ ID NO: 2658

SEQ ID NO: 57902 - protein, 81 aa, Gorilla gorilla; identical to SEQ ID NO: 2680

SEQ ID NO: 57903 - protein, 81 aa, Gorilla gorilla; identical to SEQ ID NO: 2684

SEQ ID NO: 57904 - protein, 81 aa, Gorilla gorilla; identical to SEQ ID NO: 2697

SEQ ID NO: 57905 - protein, 81 aa, Gorilla gorilla; identical to SEQ ID NO: 2740

SEQ ID NO: 57906 - protein, 81 aa, Gorilla gorilla; identical to SEQ ID NO: 2909

SEQ ID NO: 57907 - protein, 81 aa, Gorilla gorilla; identical to SEQ ID NO: 2935

SEQ ID NO: 57908 - protein, 81 aa, Gorilla gorilla; identical to SEQ ID NO: 2937

SEQ ID NO: 57909 - protein, 81 aa, Gorilla gorilla; identical to SEQ ID NO: 2941

SEQ ID NO: 57910 - protein, 81 aa, Gorilla gorilla; identical to SEQ ID NO: 2989

SEQ ID NO: 57911 - protein, 81 aa, Gorilla gorilla; identical to SEQ ID NO: 2994

SEQ ID NO: 57912 - protein, 81 aa, Gorilla gorilla; identical to SEQ ID NO: 3012

SEQ ID NO: 57913 - protein, 81 aa, Pongo abelii; identical to SEQ ID NO: 3065

SEQ ID NO: 57914 - protein, 81 aa, Pongo abelii; identical to SEQ ID NO: 3071

SEQ ID NO: 57915 - protein, 81 aa, Pongo abelii; identical to SEQ ID NO: 3083

SEQ ID NO: 57916 - protein, 81 aa, Pongo abelii; identical to SEQ ID NO: 3097

SEQ ID NO: 57917 - protein, 81 aa, Pongo abelii; identical to SEQ ID NO: 3133

SEQ ID NO: 57918 - protein, 81 aa, Pongo abelii; identical to SEQ ID NO: 3153

SEQ ID NO: 57919 - protein, 81 aa, Pongo abelii; identical to SEQ ID NO: 3238

SEQ ID NO: 57920 - protein, 81 aa, Pongo abelii; identical to SEQ ID NO: 3327

SEQ ID NO: 57921 - protein, 81 aa, Pongo abelii; identical to SEQ ID NO: 3342

SEQ ID NO: 57922 - protein, 81 aa, Pongo abelii; identical to SEQ ID NO: 3348

SEQ ID NO: 57923 - protein, 81 aa, Pongo abelii; identical to SEQ ID NO: 3364

SEQ ID NO: 57924 - protein, 81 aa, Pongo abelii; identical to SEQ ID NO: 3374

SEQ ID NO: 57925 - protein, 81 aa, Pongo abelii; identical to SEQ ID NO: 3414

SEQ ID NO: 57926 - protein, 81 aa, Pongo abelii; identical to SEQ ID NO: 3418

SEQ ID NO: 57927 - protein, 81 aa, Pongo abelii; identical to SEQ ID NO: 3495

SEQ ID NO: 57928 - protein, 81 aa, Pongo abelii; identical to SEQ ID NO: 3510

SEQ ID NO: 57929 - protein, 81 aa, Pongo abelii; identical to SEQ ID NO: 3517

SEQ ID NO: 57930 - protein, 81 aa, Pongo abelii; identical to SEQ ID NO: 3589

SEQ ID NO: 57931 - protein, 81 aa, Pongo abelii; identical to SEQ ID NO: 3618

SEQ ID NO: 57932 - protein, 81 aa, Pongo abelii; identical to SEQ ID NO: 3682

SEQ ID NO: 57933 - protein, 81 aa, Pongo abelii; identical to SEQ ID NO: 3695

SEQ ID NO: 57934 - protein, 81 aa, Pongo abelii; identical to SEQ ID NO: 3709

SEQ ID NO: 57935 - protein, 81 aa, Pongo abelii; identical to SEQ ID NO: 3748

SEQ ID NO: 57936 - protein, 81 aa, Pongo abelii; identical to SEQ ID NO: 3771

SEQ ID NO: 57937 - protein, 81 aa, Hylobates moloch; identical to SEQ ID NO: 3863

SEQ ID NO: 57938 - protein, 81 aa, Hylobates moloch; identical to SEQ ID NO: 3873

SEQ ID NO: 57939 - protein, 81 aa, Hylobates moloch; identical to SEQ ID NO: 3905

SEQ ID NO: 57940 - protein, 81 aa, Hylobates moloch; identical to SEQ ID NO: 3925

SEQ ID NO: 57941 - protein, 81 aa, Hylobates moloch; identical to SEQ ID NO: 3927

SEQ ID NO: 57942 - protein, 81 aa, Hylobates moloch; identical to SEQ ID NO: 3932

SEQ ID NO: 57943 - protein, 81 aa, Hylobates moloch; identical to SEQ ID NO: 3970

SEQ ID NO: 57944 - protein, 81 aa, Hylobates moloch; identical to SEQ ID NO: 3986

SEQ ID NO: 57945 - protein, 81 aa, Hylobates moloch; identical to SEQ ID NO: 4007

SEQ ID NO: 57946 - protein, 81 aa, Hylobates moloch; identical to SEQ ID NO: 4010

SEQ ID NO: 57947 - protein, 81 aa, Hylobates moloch; identical to SEQ ID NO: 4015

SEQ ID NO: 57948 - protein, 81 aa, Hylobates moloch; identical to SEQ ID NO: 4023

SEQ ID NO: 57949 - protein, 81 aa, Hylobates moloch; identical to SEQ ID NO: 4027

SEQ ID NO: 57950 - protein, 81 aa, Hylobates moloch; identical to SEQ ID NO: 4062

SEQ ID NO: 57951 - protein, 81 aa, Hylobates moloch; identical to SEQ ID NO: 4081

SEQ ID NO: 57952 - protein, 81 aa, Hylobates moloch; identical to SEQ ID NO: 4111

SEQ ID NO: 57953 - protein, 81 aa, Hylobates moloch; identical to SEQ ID NO: 4113

SEQ ID NO: 57954 - protein, 81 aa, Hylobates moloch; identical to SEQ ID NO: 4116

SEQ ID NO: 57955 - protein, 81 aa, Hylobates moloch; identical to SEQ ID NO: 4119

SEQ ID NO: 57956 - protein, 81 aa, Hylobates moloch; identical to SEQ ID NO: 4181

SEQ ID NO: 57957 - protein, 81 aa, Hylobates moloch; identical to SEQ ID NO: 4206

SEQ ID NO: 57958 - protein, 81 aa, Hylobates moloch; identical to SEQ ID NO: 4211

SEQ ID NO: 57959 - protein, 81 aa, Hylobates moloch; identical to SEQ ID NO: 4213

SEQ ID NO: 57960 - protein, 81 aa, Hylobates moloch; identical to SEQ ID NO: 4215

SEQ ID NO: 57961 - protein, 81 aa, Hylobates moloch; identical to SEQ ID NO: 4242

SEQ ID NO: 57962 - protein, 81 aa, Hylobates moloch; identical to SEQ ID NO: 4256

SEQ ID NO: 57963 - protein, 81 aa, Hylobates moloch; identical to SEQ ID NO: 4419

SEQ ID NO: 57964 - protein, 81 aa, Hylobates moloch; identical to SEQ ID NO: 4447

SEQ ID NO: 57965 - protein, 81 aa, Hylobates moloch; identical to SEQ ID NO: 4451

SEQ ID NO: 57966 - protein, 81 aa, Hylobates moloch; identical to SEQ ID NO: 4454

SEQ ID NO: 57967 - protein, 81 aa, Hylobates moloch; identical to SEQ ID NO: 4455

SEQ ID NO: 57968 - protein, 81 aa, Hylobates moloch; identical to SEQ ID NO: 4456

SEQ ID NO: 57969 - protein, 81 aa, Hylobates moloch; identical to SEQ ID NO: 4463

SEQ ID NO: 57970 - protein, 81 aa, Hylobates moloch; identical to SEQ ID NO: 4492

SEQ ID NO: 57971 - protein, 81 aa, Hylobates moloch; identical to SEQ ID NO: 4553

SEQ ID NO: 57972 - protein, 81 aa, Hylobates moloch; identical to SEQ ID NO: 4582

SEQ ID NO: 57973 - protein, 81 aa, Macaca mulatta; identical to SEQ ID NO: 4676

SEQ ID NO: 57974 - protein, 81 aa, Macaca mulatta; identical to SEQ ID NO: 4694

SEQ ID NO: 57975 - protein, 81 aa, Macaca mulatta; identical to SEQ ID NO: 4704

SEQ ID NO: 57976 - protein, 81 aa, Macaca mulatta; identical to SEQ ID NO: 4705

SEQ ID NO: 57977 - protein, 81 aa, Macaca mulatta; identical to SEQ ID NO: 4721

SEQ ID NO: 57978 - protein, 81 aa, Macaca mulatta; identical to SEQ ID NO: 4780

SEQ ID NO: 57979 - protein, 81 aa, Macaca mulatta; identical to SEQ ID NO: 4810

SEQ ID NO: 57980 - protein, 81 aa, Macaca mulatta; identical to SEQ ID NO: 4878

SEQ ID NO: 57981 - protein, 81 aa, Macaca mulatta; identical to SEQ ID NO: 4879

SEQ ID NO: 57982 - protein, 81 aa, Macaca mulatta; identical to SEQ ID NO: 4900

SEQ ID NO: 57983 - protein, 81 aa, Macaca mulatta; identical to SEQ ID NO: 4901

SEQ ID NO: 57984 - protein, 81 aa, Macaca mulatta; identical to SEQ ID NO: 4922

SEQ ID NO: 57985 - protein, 81 aa, Macaca mulatta; identical to SEQ ID NO: 4951

SEQ ID NO: 57986 - protein, 81 aa, Macaca mulatta; identical to SEQ ID NO: 5149

SEQ ID NO: 57987 - protein, 81 aa, Macaca mulatta; identical to SEQ ID NO: 5155

SEQ ID NO: 57988 - protein, 81 aa, Macaca mulatta; identical to SEQ ID NO: 5165

SEQ ID NO: 57989 - protein, 81 aa, Macaca mulatta; identical to SEQ ID NO: 5239

SEQ ID NO: 57990 - protein, 81 aa, Macaca mulatta; identical to SEQ ID NO: 5240

SEQ ID NO: 57991 - protein, 81 aa, Macaca mulatta; identical to SEQ ID NO: 5245

SEQ ID NO: 57992 - protein, 81 aa, Macaca mulatta; identical to SEQ ID NO: 5248

SEQ ID NO: 57993 - protein, 81 aa, Macaca mulatta; identical to SEQ ID NO: 5303

SEQ ID NO: 57994 - protein, 81 aa, Macaca mulatta; identical to SEQ ID NO: 5304

SEQ ID NO: 57995 - protein, 81 aa, Macaca mulatta; identical to SEQ ID NO: 5318

SEQ ID NO: 57996 - protein, 81 aa, Macaca mulatta; identical to SEQ ID NO: 5358

SEQ ID NO: 57997 - protein, 81 aa, Callithrix jacchus; identical to SEQ ID NO: 5513

SEQ ID NO: 57998 - protein, 81 aa, Callithrix jacchus; identical to SEQ ID NO: 5544

SEQ ID NO: 57999 - protein, 81 aa, Callithrix jacchus; identical to SEQ ID NO: 5580

SEQ ID NO: 58000 - protein, 81 aa, Callithrix jacchus; identical to SEQ ID NO: 5582

SEQ ID NO: 58001 - protein, 81 aa, Callithrix jacchus; identical to SEQ ID NO: 5634

SEQ ID NO: 58002 - protein, 81 aa, Callithrix jacchus; identical to SEQ ID NO: 5635

SEQ ID NO: 58003 - protein, 81 aa, Callithrix jacchus; identical to SEQ ID NO: 5653

SEQ ID NO: 58004 - protein, 81 aa, Callithrix jacchus; identical to SEQ ID NO: 5693

SEQ ID NO: 58005 - protein, 81 aa, Callithrix jacchus; identical to SEQ ID NO: 5699

SEQ ID NO: 58006 - protein, 81 aa, Callithrix jacchus; identical to SEQ ID NO: 5708

SEQ ID NO: 58007 - protein, 81 aa, Callithrix jacchus; identical to SEQ ID NO: 5784

SEQ ID NO: 58008 - protein, 81 aa, Callithrix jacchus; identical to SEQ ID NO: 5824

SEQ ID NO: 58009 - protein, 81 aa, Callithrix jacchus; identical to SEQ ID NO: 5841

SEQ ID NO: 58010 - protein, 81 aa, Callithrix jacchus; identical to SEQ ID NO: 5867

SEQ ID NO: 58011 - protein, 81 aa, Callithrix jacchus; identical to SEQ ID NO: 5868

SEQ ID NO: 58012 - protein, 81 aa, Callithrix jacchus; identical to SEQ ID NO: 5870

SEQ ID NO: 58013 - protein, 81 aa, Callithrix jacchus; identical to SEQ ID NO: 5893

SEQ ID NO: 58014 - protein, 81 aa, Callithrix jacchus; identical to SEQ ID NO: 5942

SEQ ID NO: 58015 - protein, 81 aa, Callithrix jacchus; identical to SEQ ID NO: 6032

SEQ ID NO: 58016 - protein, 81 aa, Callithrix jacchus; identical to SEQ ID NO: 6040

SEQ ID NO: 58017 - protein, 81 aa, Callithrix jacchus; identical to SEQ ID NO: 6041

SEQ ID NO: 58018 - protein, 81 aa, Callithrix jacchus; identical to SEQ ID NO: 6097

SEQ ID NO: 58019 - protein, 81 aa, Callithrix jacchus; identical to SEQ ID NO: 6124

SEQ ID NO: 58020 - protein, 81 aa, Callithrix jacchus; identical to SEQ ID NO: 6125

SEQ ID NO: 58021 - protein, 81 aa, Callithrix jacchus; identical to SEQ ID NO: 6148

SEQ ID NO: 58022 - protein, 81 aa, Callithrix jacchus; identical to SEQ ID NO: 6150

SEQ ID NO: 58023 - protein, 81 aa, Callithrix jacchus; identical to SEQ ID NO: 6179

SEQ ID NO: 58024 - protein, 81 aa, Callithrix jacchus; identical to SEQ ID NO: 6215

SEQ ID NO: 58025 - protein, 81 aa, Callithrix jacchus; identical to SEQ ID NO: 6218

SEQ ID NO: 58026 - protein, 81 aa, Callithrix jacchus; identical to SEQ ID NO: 6221

SEQ ID NO: 58027 - protein, 81 aa, Callithrix jacchus; identical to SEQ ID NO: 6222

SEQ ID NO: 58028 - protein, 81 aa, Callithrix jacchus; identical to SEQ ID NO: 6244

SEQ ID NO: 58029 - protein, 81 aa, Aotus trivirgatus; identical to SEQ ID NO: 6307

SEQ ID NO: 58030 - protein, 81 aa, Aotus trivirgatus; identical to SEQ ID NO: 6320

SEQ ID NO: 58031 - protein, 81 aa, Aotus trivirgatus; identical to SEQ ID NO: 6336

SEQ ID NO: 58032 - protein, 81 aa, Aotus trivirgatus; identical to SEQ ID NO: 6354

SEQ ID NO: 58033 - protein, 81 aa, Aotus trivirgatus; identical to SEQ ID NO: 6365

SEQ ID NO: 58034 - protein, 81 aa, Aotus trivirgatus; identical to SEQ ID NO: 6367

SEQ ID NO: 58035 - protein, 81 aa, Aotus trivirgatus; identical to SEQ ID NO: 6386

SEQ ID NO: 58036 - protein, 81 aa, Aotus trivirgatus; identical to SEQ ID NO: 6392

SEQ ID NO: 58037 - protein, 81 aa, Aotus trivirgatus; identical to SEQ ID NO: 6418

SEQ ID NO: 58038 - protein, 81 aa, Aotus trivirgatus; identical to SEQ ID NO: 6456

SEQ ID NO: 58039 - protein, 81 aa, Aotus trivirgatus; identical to SEQ ID NO: 6489

SEQ ID NO: 58040 - protein, 81 aa, Aotus trivirgatus; identical to SEQ ID NO: 6559

SEQ ID NO: 58041 - protein, 81 aa, Aotus trivirgatus; identical to SEQ ID NO: 6604

SEQ ID NO: 58042 - protein, 81 aa, Aotus trivirgatus; identical to SEQ ID NO: 6608

SEQ ID NO: 58043 - protein, 81 aa, Aotus trivirgatus; identical to SEQ ID NO: 6637

SEQ ID NO: 58044 - protein, 81 aa, Aotus trivirgatus; identical to SEQ ID NO: 6646

SEQ ID NO: 58045 - protein, 81 aa, Aotus trivirgatus; identical to SEQ ID NO: 6722

SEQ ID NO: 58046 - protein, 81 aa, Aotus trivirgatus; identical to SEQ ID NO: 6835

SEQ ID NO: 58047 - protein, 81 aa, Homo sapiens; identical to SEQ ID NO: 420

SEQ ID NO: 58048 - protein, 81 aa, Rattus norvegicus; identical to SEQ ID NO: 6884

SEQ ID NO: 58049 - protein, 81 aa, Homo sapiens; identical to SEQ ID NO: 437

SEQ ID NO: 58050 - protein, 81 aa, Homo sapiens; identical to SEQ ID NO: 444

SEQ ID NO: 58051 - protein, 81 aa, Homo sapiens; identical to SEQ ID NO: 450

SEQ ID NO: 58052 - protein, 81 aa, Homo sapiens; identical to SEQ ID NO: 451

SEQ ID NO: 58053 - protein, 81 aa, Homo sapiens; identical to SEQ ID NO: 463

SEQ ID NO: 58054 - protein, 81 aa, Homo sapiens; identical to SEQ ID NO: 474

SEQ ID NO: 58055 - protein, 81 aa, Homo sapiens; identical to SEQ ID NO: 488

SEQ ID NO: 58056 - protein, 81 aa, Homo sapiens; identical to SEQ ID NO: 508

SEQ ID NO: 58057 - protein, 81 aa, Homo sapiens; identical to SEQ ID NO: 520

SEQ ID NO: 58058 - protein, 81 aa, Bos taurus; identical to SEQ ID NO: 7015

SEQ ID NO: 58059 - protein, 81 aa, Homo sapiens; identical to SEQ ID NO: 533

SEQ ID NO: 58060 - protein, 81 aa, Homo sapiens; identical to SEQ ID NO: 544

SEQ ID NO: 58061 - protein, 81 aa, Homo sapiens; identical to SEQ ID NO: 550

SEQ ID NO: 58062 - protein, 81 aa, Mus musculus; identical to SEQ ID NO: 7062

SEQ ID NO: 58063 - protein, 81 aa, Homo sapiens; identical to SEQ ID NO: 566

SEQ ID NO: 58064 - protein, 81 aa, Bos taurus; identical to SEQ ID NO: 7087

SEQ ID NO: 58065 - protein, 81 aa, Homo sapiens; identical to SEQ ID NO: 595

SEQ ID NO: 58066 - protein, 81 aa, Mus musculus; identical to SEQ ID NO: 7108

SEQ ID NO: 58067 - protein, 81 aa, Pongo abelii; identical to SEQ ID NO: 7113

SEQ ID NO: 58068 - protein, 81 aa, Homo sapiens; identical to SEQ ID NO: 635

SEQ ID NO: 58069 - protein, 81 aa, Pongo abelii; identical to SEQ ID NO: 7172

SEQ ID NO: 58070 - protein, 81 aa, Homo sapiens; identical to SEQ ID NO: 655

SEQ ID NO: 58071 - protein, 81 aa, Homo sapiens; identical to SEQ ID NO: 665

SEQ ID NO: 58072 - protein, 81 aa, Homo sapiens; identical to SEQ ID NO: 717

SEQ ID NO: 58073 - protein, 81 aa, Homo sapiens; identical to SEQ ID NO: 751

SEQ ID NO: 58074 - protein, 81 aa, Homo sapiens; identical to SEQ ID NO: 754

SEQ ID NO: 58075 - protein, 81 aa, Saimiri boliviensis boliviensis; identical to SEQ ID NO: 7368

SEQ ID NO: 58076 - protein, 81 aa, Rattus norvegicus; identical to SEQ ID NO: 7412

SEQ ID NO: 58077 - protein, 81 aa, Terrapene carolina triunguis; identical to SEQ ID NO: 7473

SEQ ID NO: 58078 - protein, 81 aa, Terrapene carolina triunguis; identical to SEQ ID NO: 7475

SEQ ID NO: 58079 - protein, 81 aa, Gopherus agassizii; identical to SEQ ID NO: 7501

SEQ ID NO: 58080 - protein, 81 aa, Gopherus agassizii; identical to SEQ ID NO: 7517

SEQ ID NO: 58081 - protein, 81 aa, Podarcis muralis; identical to SEQ ID NO: 7529

SEQ ID NO: 58082 - protein, 81 aa, Podarcis muralis; identical to SEQ ID NO: 7552

SEQ ID NO: 58083 - protein, 81 aa, Gopherus agassizii; identical to SEQ ID NO: 7577

SEQ ID NO: 58084 - protein, 81 aa, Alligator sinensis; identical to SEQ ID NO: 7591

SEQ ID NO: 58085 - protein, 81 aa, Paroedura picta; identical to SEQ ID NO: 7601

SEQ ID NO: 58086 - protein, 81 aa, Paroedura picta; identical to SEQ ID NO: 7620

SEQ ID NO: 58087 - protein, 81 aa, Paroedura picta; identical to SEQ ID NO: 7658

SEQ ID NO: 58088 - protein, 81 aa, Paroedura picta; identical to SEQ ID NO: 7674

SEQ ID NO: 58089 - protein, 81 aa, Terrapene carolina triunguis; identical to SEQ ID NO: 7696

SEQ ID NO: 58090 - protein, 81 aa, Terrapene carolina triunguis; identical to SEQ ID NO: 7714

SEQ ID NO: 58091 - protein, 81 aa, Terrapene carolina triunguis; identical to SEQ ID NO: 7718

SEQ ID NO: 58092 - protein, 81 aa, Podarcis muralis; identical to SEQ ID NO: 7816

SEQ ID NO: 58093 - protein, 81 aa, Microcaecilia unicolor; identical to SEQ ID NO: 7856

SEQ ID NO: 58094 - protein, 81 aa, Microcaecilia unicolor; identical to SEQ ID NO: 7857

SEQ ID NO: 58095 - protein, 81 aa, Microcaecilia unicolor; identical to SEQ ID NO: 7860

SEQ ID NO: 58096 - protein, 81 aa, Alligator mississippiensis; identical to SEQ ID NO: 7985

SEQ ID NO: 58097 - protein, 81 aa, Callipepla squamata; identical to SEQ ID NO: 8055

SEQ ID NO: 58098 - protein, 81 aa, Alligator mississippiensis; identical to SEQ ID NO: 8057

SEQ ID NO: 58099 - protein, 81 aa, Alligator mississippiensis; identical to SEQ ID NO: 8071

SEQ ID NO: 58100 - protein, 81 aa, Phasianus colchicus; identical to SEQ ID NO: 8089

SEQ ID NO: 58101 - protein, 81 aa, Phasianus colchicus; identical to SEQ ID NO: 8119

SEQ ID NO: 58102 - protein, 81 aa, Microcaecilia unicolor; identical to SEQ ID NO: 8217

SEQ ID NO: 58103 - protein, 81 aa, Microcaecilia unicolor; identical to SEQ ID NO: 8228

SEQ ID NO: 58104 - protein, 81 aa, Microcaecilia unicolor; identical to SEQ ID NO: 8242

SEQ ID NO: 58105 - protein, 81 aa, Microcaecilia unicolor; identical to SEQ ID NO: 8285

SEQ ID NO: 58106 - protein, 81 aa, Microcaecilia unicolor; identical to SEQ ID NO: 8302

SEQ ID NO: 58107 - protein, 81 aa, Microcaecilia unicolor; identical to SEQ ID NO: 8303

SEQ ID NO: 58108 - protein, 81 aa, Terrapene carolina triunguis; identical to SEQ ID NO: 8447

SEQ ID NO: 58109 - protein, 81 aa, Microcaecilia unicolor; identical to SEQ ID NO: 8472

SEQ ID NO: 58110 - protein, 81 aa, Microcaecilia unicolor; identical to SEQ ID NO: 8484

SEQ ID NO: 58111 - protein, 81 aa, Gopherus agassizii; identical to SEQ ID NO: 8599

SEQ ID NO: 58112 - protein, 81 aa, Gopherus agassizii; identical to SEQ ID NO: 8629

SEQ ID NO: 58113 - protein, 81 aa, Gopherus agassizii; identical to SEQ ID NO: 8653

SEQ ID NO: 58114 - protein, 81 aa, Gopherus agassizii; identical to SEQ ID NO: 8672

SEQ ID NO: 58115 - protein, 81 aa, Alligator sinensis; identical to SEQ ID NO: 8724

SEQ ID NO: 58116 - protein, 81 aa, Alligator sinensis; identical to SEQ ID NO: 8726

SEQ ID NO: 58117 - protein, 81 aa, Gallus gallus; identical to SEQ ID NO: 8760

SEQ ID NO: 58118 - protein, 81 aa, Gallus gallus; identical to SEQ ID NO: 8772

SEQ ID NO: 58119 - protein, 81 aa, Chelonia mydas; identical to SEQ ID NO: 8797

SEQ ID NO: 58120 - protein, 81 aa, Columba livia; identical to SEQ ID NO: 8830

SEQ ID NO: 58121 - protein, 81 aa, Pogona vitticeps; identical to SEQ ID NO: 8835

SEQ ID NO: 58122 - protein, 81 aa, Meleagris gallopavo; identical to SEQ ID NO: 8864

SEQ ID NO: 58123 - protein, 81 aa, Columba livia; identical to SEQ ID NO: 8869

SEQ ID NO: 58124 - protein, 81 aa, Pogona vitticeps; identical to SEQ ID NO: 8893

SEQ ID NO: 58125 - protein, 81 aa, Chelonia mydas; identical to SEQ ID NO: 8915

SEQ ID NO: 58126 - protein, 81 aa, Columba livia; identical to SEQ ID NO: 8932

SEQ ID NO: 58127 - protein, 81 aa, Columba livia; identical to SEQ ID NO: 8943

SEQ ID NO: 58128 - protein, 81 aa, Terrapene carolina triunguis; identical to SEQ ID NO: 8969

SEQ ID NO: 58129 - protein, 81 aa, Patagioenas fasciata monilis; identical to SEQ ID NO: 9014

SEQ ID NO: 58130 - protein, 81 aa, Gallus gallus; identical to SEQ ID NO: 9044

SEQ ID NO: 58131 - protein, 81 aa, Callipepla squamata; identical to SEQ ID NO: 9131

SEQ ID NO: 58132 - protein, 81 aa, Callipepla squamata; identical to SEQ ID NO: 9132

SEQ ID NO: 58133 - protein, 81 aa, Callipepla squamata; identical to SEQ ID NO: 9133

SEQ ID NO: 58134 - protein, 81 aa, Alligator mississippiensis; identical to SEQ ID NO: 9155

SEQ ID NO: 58135 - protein, 81 aa, Dipodomys ordii; identical to SEQ ID NO: 9160

SEQ ID NO: 58136 - protein, 81 aa, Cavia porcellus; identical to SEQ ID NO: 9173

SEQ ID NO: 58137 - protein, 81 aa, Cricetulus griseus; identical to SEQ ID NO: 9267

SEQ ID NO: 58138 - protein, 81 aa, Cricetulus griseus; identical to SEQ ID NO: 9270

SEQ ID NO: 58139 - protein, 81 aa, Cricetulus griseus; identical to SEQ ID NO: 9273

SEQ ID NO: 58140 - protein, 81 aa, Mus musculus; identical to SEQ ID NO: 9286

SEQ ID NO: 58141 - protein, 81 aa, Mesocricetus auratus; identical to SEQ ID NO: 9298

SEQ ID NO: 58142 - protein, 81 aa, Mus caroli; identical to SEQ ID NO: 9301

SEQ ID NO: 58143 - protein, 81 aa, Cricetulus griseus; identical to SEQ ID NO: 9335

SEQ ID NO: 58144 - protein, 81 aa, Rattus norvegicus; identical to SEQ ID NO: 9345

SEQ ID NO: 58145 - protein, 81 aa, Mus caroli; identical to SEQ ID NO: 9354

SEQ ID NO: 58146 - protein, 81 aa, Peromyscus maniculatus bairdii; identical to SEQ ID NO: 9401

SEQ ID NO: 58147 - protein, 81 aa, Peromyscus maniculatus bairdii; identical to SEQ ID NO: 9408

SEQ ID NO: 58148 - protein, 81 aa, Mesocricetus auratus; identical to SEQ ID NO: 9420

SEQ ID NO: 58149 - protein, 81 aa, Ictidomys tridecemlineatus; identical to SEQ ID NO: 9422

SEQ ID NO: 58150 - protein, 81 aa, Ictidomys tridecemlineatus; identical to SEQ ID NO: 9424

SEQ ID NO: 58151 - protein, 81 aa, Marmota monax; identical to SEQ ID NO: 9427

SEQ ID NO: 58152 - protein, 81 aa, Mus caroli; identical to SEQ ID NO: 9436

SEQ ID NO: 58153 - protein, 81 aa, Peromyscus maniculatus bairdii; identical to SEQ ID NO: 9459

SEQ ID NO: 58154 - protein, 81 aa, Peromyscus maniculatus bairdii; identical to SEQ ID NO: 9472

SEQ ID NO: 58155 - protein, 81 aa, Cavia porcellus; identical to SEQ ID NO: 9489

SEQ ID NO: 58156 - protein, 81 aa, Mus musculus; identical to SEQ ID NO: 9531

SEQ ID NO: 58157 - protein, 81 aa, Cricetulus griseus; identical to SEQ ID NO: 9537

SEQ ID NO: 58158 - protein, 81 aa, Peromyscus maniculatus bairdii; identical to SEQ ID NO: 9543

SEQ ID NO: 58159 - protein, 81 aa, Peromyscus maniculatus bairdii; identical to SEQ ID NO: 9544

SEQ ID NO: 58160 - protein, 81 aa, Peromyscus maniculatus bairdii; identical to SEQ ID NO: 9579

SEQ ID NO: 58161 - protein, 81 aa, Mesocricetus auratus; identical to SEQ ID NO: 9586

SEQ ID NO: 58162 - protein, 81 aa, Mus caroli; identical to SEQ ID NO: 9608

SEQ ID NO: 58163 - protein, 81 aa, Mus musculus; identical to SEQ ID NO: 9611

SEQ ID NO: 58164 - protein, 81 aa, Cricetulus griseus; identical to SEQ ID NO: 9621

SEQ ID NO: 58165 - protein, 81 aa, Rattus norvegicus; identical to SEQ ID NO: 9664

SEQ ID NO: 58166 - protein, 81 aa, Mus musculus; identical to SEQ ID NO: 9665

SEQ ID NO: 58167 - protein, 81 aa, Mus caroli; identical to SEQ ID NO: 9666

SEQ ID NO: 58168 - protein, 81 aa, Mus caroli; identical to SEQ ID NO: 9668

SEQ ID NO: 58169 - protein, 81 aa, Cricetulus griseus; identical to SEQ ID NO: 9674

SEQ ID NO: 58170 - protein, 81 aa, Mesocricetus auratus; identical to SEQ ID NO: 9737

SEQ ID NO: 58171 - protein, 81 aa, Mus musculus; identical to SEQ ID NO: 9807

SEQ ID NO: 58172 - protein, 81 aa, Mus musculus; identical to SEQ ID NO: 9808

SEQ ID NO: 58173 - protein, 81 aa, Mesocricetus auratus; identical to SEQ ID NO: 9831

SEQ ID NO: 58174 - protein, 81 aa, Peromyscus maniculatus bairdii; identical to SEQ ID NO: 9861

SEQ ID NO: 58175 - protein, 81 aa, Mesocricetus auratus; identical to SEQ ID NO: 9865

SEQ ID NO: 58176 - protein, 81 aa, Marmota monax; identical to SEQ ID NO: 9908

SEQ ID NO: 58177 - protein, 81 aa, Mus caroli; identical to SEQ ID NO: 9912

SEQ ID NO: 58178 - protein, 81 aa, Peromyscus maniculatus bairdii; identical to SEQ ID NO: 9935

SEQ ID NO: 58179 - protein, 81 aa, Cavia porcellus; identical to SEQ ID NO: 9949

SEQ ID NO: 58180 - protein, 81 aa, Peromyscus maniculatus bairdii; identical to SEQ ID NO: 9958

SEQ ID NO: 58181 - protein, 81 aa, Peromyscus maniculatus bairdii; identical to SEQ ID NO: 9963

SEQ ID NO: 58182 - protein, 81 aa, Peromyscus maniculatus bairdii; identical to SEQ ID NO: 9969

SEQ ID NO: 58183 - protein, 81 aa, Marmota monax; identical to SEQ ID NO: 9981

SEQ ID NO: 58184 - protein, 81 aa, Cricetulus griseus; identical to SEQ ID NO: 10000

SEQ ID NO: 58185 - protein, 81 aa, Cricetulus griseus; identical to SEQ ID NO: 10005

SEQ ID NO: 58186 - protein, 81 aa, Mesocricetus auratus; identical to SEQ ID NO: 10018

SEQ ID NO: 58187 - protein, 81 aa, Cricetulus griseus; identical to SEQ ID NO: 10050

SEQ ID NO: 58188 - protein, 81 aa, Cricetulus griseus; identical to SEQ ID NO: 10055

SEQ ID NO: 58189 - protein, 81 aa, Mus caroli; identical to SEQ ID NO: 10072

SEQ ID NO: 58190 - protein, 81 aa, Mesocricetus auratus; identical to SEQ ID NO: 10101

SEQ ID NO: 58191 - protein, 81 aa, Marmota monax; identical to SEQ ID NO: 10108

SEQ ID NO: 58192 - protein, 80 aa, Mus musculus; identical to SEQ ID NO: 10131

SEQ ID NO: 58193 - protein, 81 aa, Mus caroli; identical to SEQ ID NO: 10161

SEQ ID NO: 58194 - protein, 81 aa, Cricetulus griseus; identical to SEQ ID NO: 10179

SEQ ID NO: 58195 - protein, 81 aa, Mesocricetus auratus; identical to SEQ ID NO: 10238

SEQ ID NO: 58196 - protein, 81 aa, Mus caroli; identical to SEQ ID NO: 10260

SEQ ID NO: 58197 - protein, 81 aa, Dipodomys ordii; identical to SEQ ID NO: 10278

SEQ ID NO: 58198 - protein, 81 aa, Peromyscus maniculatus bairdii; identical to SEQ ID NO: 10293

SEQ ID NO: 58199 - protein, 81 aa, Peromyscus maniculatus bairdii; identical to SEQ ID NO: 10294

SEQ ID NO: 58200 - protein, 81 aa, Heterocephalus glaber; identical to SEQ ID NO: 10308

SEQ ID NO: 58201 - protein, 81 aa, Mus caroli; identical to SEQ ID NO: 10311

SEQ ID NO: 58202 - protein, 81 aa, Mesocricetus auratus; identical to SEQ ID NO: 10336

SEQ ID NO: 58203 - protein, 81 aa, Mus musculus; identical to SEQ ID NO: 10354

SEQ ID NO: 58204 - protein, 81 aa, Marmota monax; identical to SEQ ID NO: 10369

SEQ ID NO: 58205 - protein, 81 aa, Mus musculus; identical to SEQ ID NO: 10384

SEQ ID NO: 58206 - protein, 81 aa, Peromyscus maniculatus bairdii; identical to SEQ ID NO: 10409

SEQ ID NO: 58207 - protein, 81 aa, Marmota monax; identical to SEQ ID NO: 10422

SEQ ID NO: 58208 - protein, 81 aa, Mus musculus; identical to SEQ ID NO: 10432

SEQ ID NO: 58209 - protein, 81 aa, Peromyscus maniculatus bairdii; identical to SEQ ID NO: 10443

SEQ ID NO: 58210 - protein, 81 aa, Peromyscus maniculatus bairdii; identical to SEQ ID NO: 10448

SEQ ID NO: 58211 - protein, 81 aa, Peromyscus maniculatus bairdii; identical to SEQ ID NO: 10451

SEQ ID NO: 58212 - protein, 81 aa, Ictidomys tridecemlineatus; identical to SEQ ID NO: 10475

SEQ ID NO: 58213 - protein, 81 aa, Marmota monax; identical to SEQ ID NO: 10508

SEQ ID NO: 58214 - protein, 81 aa, Dipodomys ordii; identical to SEQ ID NO: 10543

SEQ ID NO: 58215 - protein, 81 aa, Fukomys damarensis; identical to SEQ ID NO: 10554

SEQ ID NO: 58216 - protein, 81 aa, Marmota monax; identical to SEQ ID NO: 10565

SEQ ID NO: 58217 - protein, 81 aa, Dipodomys ordii; identical to SEQ ID NO: 10608

SEQ ID NO: 58218 - protein, 81 aa, Ictidomys tridecemlineatus; identical to SEQ ID NO: 10622

SEQ ID NO: 58219 - protein, 81 aa, Mesocricetus auratus; identical to SEQ ID NO: 10645

SEQ ID NO: 58220 - protein, 81 aa, Mesocricetus auratus; identical to SEQ ID NO: 10649

SEQ ID NO: 58221 - protein, 81 aa, Dipodomys ordii; identical to SEQ ID NO: 10660

SEQ ID NO: 58222 - protein, 81 aa, Octodon degus; identical to SEQ ID NO: 10661

SEQ ID NO: 58223 - protein, 81 aa, Octodon degus; identical to SEQ ID NO: 10663

SEQ ID NO: 58224 - protein, 81 aa, Mus caroli; identical to SEQ ID NO: 10678

SEQ ID NO: 58225 - protein, 81 aa, Mus musculus; identical to SEQ ID NO: 10682

SEQ ID NO: 58226 - protein, 81 aa, Octodon degus; identical to SEQ ID NO: 10695

SEQ ID NO: 58227 - protein, 81 aa, Mesocricetus auratus; identical to SEQ ID NO: 10736

SEQ ID NO: 58228 - protein, 81 aa, Dipodomys ordii; identical to SEQ ID NO: 10762

SEQ ID NO: 58229 - protein, 81 aa, Octodon degus; identical to SEQ ID NO: 10816

SEQ ID NO: 58230 - protein, 81 aa, Dipodomys ordii; identical to SEQ ID NO: 10823

SEQ ID NO: 58231 - protein, 81 aa, Octodon degus; identical to SEQ ID NO: 10825

SEQ ID NO: 58232 - protein, 81 aa, Cricetulus griseus; identical to SEQ ID NO: 10832

SEQ ID NO: 58233 - protein, 81 aa, Mus caroli; identical to SEQ ID NO: 10835

SEQ ID NO: 58234 - protein, 81 aa, Mus caroli; identical to SEQ ID NO: 10842

SEQ ID NO: 58235 - protein, 81 aa, Mus caroli; identical to SEQ ID NO: 10844

SEQ ID NO: 58236 - protein, 81 aa, Marmota monax; identical to SEQ ID NO: 10895

SEQ ID NO: 58237 - protein, 81 aa, Mus caroli; identical to SEQ ID NO: 10906

SEQ ID NO: 58238 - protein, 81 aa, Mus musculus; identical to SEQ ID NO: 10908

SEQ ID NO: 58239 - protein, 81 aa, Ictidomys tridecemlineatus; identical to SEQ ID NO: 10941

SEQ ID NO: 58240 - protein, 81 aa, Heterocephalus glaber; identical to SEQ ID NO: 10943

SEQ ID NO: 58241 - protein, 81 aa, Mus caroli; identical to SEQ ID NO: 10946

SEQ ID NO: 58242 - protein, 81 aa, Mus musculus; identical to SEQ ID NO: 10962

SEQ ID NO: 58243 - protein, 81 aa, Cricetulus griseus; identical to SEQ ID NO: 10965

SEQ ID NO: 58244 - protein, 81 aa, Mesocricetus auratus; identical to SEQ ID NO: 10976

SEQ ID NO: 58245 - protein, 81 aa, Mesocricetus auratus; identical to SEQ ID NO: 10977

SEQ ID NO: 58246 - protein, 81 aa, Marmota monax; identical to SEQ ID NO: 10997

SEQ ID NO: 58247 - protein, 81 aa, Mus caroli; identical to SEQ ID NO: 11010

SEQ ID NO: 58248 - protein, 81 aa, Mus caroli; identical to SEQ ID NO: 11034

SEQ ID NO: 58249 - protein, 81 aa, Rattus norvegicus; identical to SEQ ID NO: 11081

SEQ ID NO: 58250 - protein, 81 aa, Rattus norvegicus; identical to SEQ ID NO: 11112

SEQ ID NO: 58251 - protein, 81 aa, Octodon degus; identical to SEQ ID NO: 11137

SEQ ID NO: 58252 - protein, 81 aa, Mus caroli; identical to SEQ ID NO: 11160

SEQ ID NO: 58253 - protein, 81 aa, Mus musculus; identical to SEQ ID NO: 11163

SEQ ID NO: 58254 - protein, 81 aa, Octodon degus; identical to SEQ ID NO: 11169

SEQ ID NO: 58255 - protein, 81 aa, Mus musculus; identical to SEQ ID NO: 11176

SEQ ID NO: 58256 - protein, 81 aa, Fukomys damarensis; identical to SEQ ID NO: 11210

SEQ ID NO: 58257 - protein, 81 aa, Peromyscus maniculatus bairdii; identical to SEQ ID NO: 11246

SEQ ID NO: 58258 - protein, 81 aa, Ictidomys tridecemlineatus; identical to SEQ ID NO: 11279

SEQ ID NO: 58259 - protein, 81 aa, Mus caroli; identical to SEQ ID NO: 11303

SEQ ID NO: 58260 - protein, 81 aa, Octodon degus; identical to SEQ ID NO: 11360

SEQ ID NO: 58261 - protein, 81 aa, Octodon degus; identical to SEQ ID NO: 11376

SEQ ID NO: 58262 - protein, 81 aa, Mus musculus; identical to SEQ ID NO: 11413

SEQ ID NO: 58263 - protein, 81 aa, Mustela putorius furo; identical to SEQ ID NO: 11453

SEQ ID NO: 58264 - protein, 81 aa, Delphinapterus leucas; identical to SEQ ID NO: 11470

SEQ ID NO: 58265 - protein, 81 aa, Delphinapterus leucas; identical to SEQ ID NO: 11478

SEQ ID NO: 58266 - protein, 81 aa, Vicugna pacos; identical to SEQ ID NO: 11500

SEQ ID NO: 58267 - protein, 81 aa, Odobenus rosmarus divergens; identical to SEQ ID NO: 11505

SEQ ID NO: 58268 - protein, 81 aa, Vicugna pacos; identical to SEQ ID NO: 11522

SEQ ID NO: 58269 - protein, 81 aa, Odobenus rosmarus divergens; identical to SEQ ID NO: 11539

SEQ ID NO: 58270 - protein, 81 aa, Delphinapterus leucas; identical to SEQ ID NO: 11544

SEQ ID NO: 58271 - protein, 81 aa, Carlito syrichta; identical to SEQ ID NO: 11546

SEQ ID NO: 58272 - protein, 81 aa, Vicugna pacos; identical to SEQ ID NO: 11610

SEQ ID NO: 58273 - protein, 81 aa, Delphinapterus leucas; identical to SEQ ID NO: 11614

SEQ ID NO: 58274 - protein, 81 aa, Delphinapterus leucas; identical to SEQ ID NO: 11645

SEQ ID NO: 58275 - protein, 81 aa, Cervus elaphus hippelaphus; identical to SEQ ID NO: 11692

SEQ ID NO: 58276 - protein, 81 aa, Vicugna pacos; identical to SEQ ID NO: 11731

SEQ ID NO: 58277 - protein, 81 aa, Odobenus rosmarus divergens; identical to SEQ ID NO: 11732

SEQ ID NO: 58278 - protein, 81 aa, Carlito syrichta; identical to SEQ ID NO: 11742

SEQ ID NO: 58279 - protein, 81 aa, Delphinapterus leucas; identical to SEQ ID NO: 11765

SEQ ID NO: 58280 - protein, 81 aa, Delphinapterus leucas; identical to SEQ ID NO: 11766

SEQ ID NO: 58281 - protein, 81 aa, Ornithorhynchus anatinus; identical to SEQ ID NO: 11794

SEQ ID NO: 58282 - protein, 81 aa, Odobenus rosmarus divergens; identical to SEQ ID NO: 11803

SEQ ID NO: 58283 - protein, 81 aa, Colobus angolensis palliatus; identical to SEQ ID NO: 11823

SEQ ID NO: 58284 - protein, 81 aa, Colobus angolensis palliatus; identical to SEQ ID NO: 11824

SEQ ID NO: 58285 - protein, 81 aa, Odobenus rosmarus divergens; identical to SEQ ID NO: 11852

SEQ ID NO: 58286 - protein, 81 aa, Erinaceus europaeus; identical to SEQ ID NO: 11881

SEQ ID NO: 58287 - protein, 81 aa, Mustela putorius furo; identical to SEQ ID NO: 11882

SEQ ID NO: 58288 - protein, 81 aa, Mustela putorius furo; identical to SEQ ID NO: 11884

SEQ ID NO: 58289 - protein, 81 aa, Erinaceus europaeus; identical to SEQ ID NO: 11926

SEQ ID NO: 58290 - protein, 81 aa, Vicugna pacos; identical to SEQ ID NO: 12001

SEQ ID NO: 58291 - protein, 81 aa, Vicugna pacos; identical to SEQ ID NO: 12021

SEQ ID NO: 58292 - protein, 81 aa, Odobenus rosmarus divergens; identical to SEQ ID NO: 12036

SEQ ID NO: 58293 - protein, 81 aa, Cervus elaphus hippelaphus; identical to SEQ ID NO: 12062

SEQ ID NO: 58294 - protein, 81 aa, Chelonia mydas; identical to SEQ ID NO: 12093

SEQ ID NO: 58295 - protein, 81 aa, Loxodonta africana; identical to SEQ ID NO: 12125

SEQ ID NO: 58296 - protein, 81 aa, Suricata suricatta; identical to SEQ ID NO: 12143

SEQ ID NO: 58297 - protein, 81 aa, Mandrillus leucophaeus; identical to SEQ ID NO: 12150

SEQ ID NO: 58298 - protein, 81 aa, Mandrillus leucophaeus; identical to SEQ ID NO: 12153

SEQ ID NO: 58299 - protein, 81 aa, Sus scrofa; identical to SEQ ID NO: 12159

SEQ ID NO: 58300 - protein, 81 aa, Neophocaena asiaeorientalis asiaeorientalis; identical to SEQ ID NO: 12168

SEQ ID NO: 58301 - protein, 81 aa, Nomascus leucogenys; identical to SEQ ID NO: 12172

SEQ ID NO: 58302 - protein, 81 aa, Capra hircus; identical to SEQ ID NO: 12188

SEQ ID NO: 58303 - protein, 81 aa, Chrysochloris asiatica; identical to SEQ ID NO: 12190

SEQ ID NO: 58304 - protein, 81 aa, Mandrillus leucophaeus; identical to SEQ ID NO: 12216

SEQ ID NO: 58305 - protein, 81 aa, Sus scrofa; identical to SEQ ID NO: 12229

SEQ ID NO: 58306 - protein, 81 aa, Nomascus leucogenys; identical to SEQ ID NO: 12248

SEQ ID NO: 58307 - protein, 81 aa, Nomascus leucogenys; identical to SEQ ID NO: 12249

SEQ ID NO: 58308 - protein, 81 aa, Bos indicus; identical to SEQ ID NO: 12251

SEQ ID NO: 58309 - protein, 81 aa, Suricata suricatta; identical to SEQ ID NO: 12276

SEQ ID NO: 58310 - protein, 81 aa, Chrysochloris asiatica; identical to SEQ ID NO: 12277

SEQ ID NO: 58311 - protein, 81 aa, Mandrillus leucophaeus; identical to SEQ ID NO: 12281

SEQ ID NO: 58312 - protein, 81 aa, Sus scrofa; identical to SEQ ID NO: 12297

SEQ ID NO: 58313 - protein, 81 aa, Neophocaena asiaeorientalis asiaeorientalis; identical to SEQ ID NO: 12311

SEQ ID NO: 58314 - protein, 81 aa, Nomascus leucogenys; identical to SEQ ID NO: 12321

SEQ ID NO: 58315 - protein, 81 aa, Nomascus leucogenys; identical to SEQ ID NO: 12323

SEQ ID NO: 58316 - protein, 81 aa, Capra hircus; identical to SEQ ID NO: 12344

SEQ ID NO: 58317 - protein, 81 aa, Capra hircus; identical to SEQ ID NO: 12346

SEQ ID NO: 58318 - protein, 81 aa, Sus scrofa; identical to SEQ ID NO: 12383

SEQ ID NO: 58319 - protein, 81 aa, Sus scrofa; identical to SEQ ID NO: 12384

SEQ ID NO: 58320 - protein, 81 aa, Suricata suricatta; identical to SEQ ID NO: 12401

SEQ ID NO: 58321 - protein, 81 aa, Suricata suricatta; identical to SEQ ID NO: 12408

SEQ ID NO: 58322 - protein, 81 aa, Suricata suricatta; identical to SEQ ID NO: 12410

SEQ ID NO: 58323 - protein, 81 aa, Mandrillus leucophaeus; identical to SEQ ID NO: 12426

SEQ ID NO: 58324 - protein, 81 aa, Sus scrofa; identical to SEQ ID NO: 12431

SEQ ID NO: 58325 - protein, 81 aa, Sus scrofa; identical to SEQ ID NO: 12433

SEQ ID NO: 58326 - protein, 81 aa, Nomascus leucogenys; identical to SEQ ID NO: 12440

SEQ ID NO: 58327 - protein, 81 aa, Capra hircus; identical to SEQ ID NO: 12450

SEQ ID NO: 58328 - protein, 81 aa, Capra hircus; identical to SEQ ID NO: 12451

SEQ ID NO: 58329 - protein, 81 aa, Sus scrofa; identical to SEQ ID NO: 12475

SEQ ID NO: 58330 - protein, 81 aa, Sus scrofa; identical to SEQ ID NO: 12478

SEQ ID NO: 58331 - protein, 81 aa, Nomascus leucogenys; identical to SEQ ID NO: 12500

SEQ ID NO: 58332 - protein, 81 aa, Suricata suricatta; identical to SEQ ID NO: 12512

SEQ ID NO: 58333 - protein, 81 aa, Suricata suricatta; identical to SEQ ID NO: 12520

SEQ ID NO: 58334 - protein, 81 aa, Suricata suricatta; identical to SEQ ID NO: 12522

SEQ ID NO: 58335 - protein, 81 aa, Sus scrofa; identical to SEQ ID NO: 12532

SEQ ID NO: 58336 - protein, 81 aa, Neophocaena asiaeorientalis asiaeorientalis; identical to SEQ ID NO: 12552

SEQ ID NO: 58337 - protein, 81 aa, Nomascus leucogenys; identical to SEQ ID NO: 12565

SEQ ID NO: 58338 - protein, 81 aa, Equus caballus; identical to SEQ ID NO: 12580

SEQ ID NO: 58339 - protein, 81 aa, Suricata suricatta; identical to SEQ ID NO: 12585

SEQ ID NO: 58340 - protein, 81 aa, Mandrillus leucophaeus; identical to SEQ ID NO: 12589

SEQ ID NO: 58341 - protein, 81 aa, Trichechus manatus latirostris; identical to SEQ ID NO: 12621

SEQ ID NO: 58342 - protein, 81 aa, Trichechus manatus latirostris; identical to SEQ ID NO: 12624

SEQ ID NO: 58343 - protein, 81 aa, Sus scrofa; identical to SEQ ID NO: 12653

SEQ ID NO: 58344 - protein, 81 aa, Nomascus leucogenys; identical to SEQ ID NO: 12673

SEQ ID NO: 58345 - protein, 81 aa, Zalophus californianus; identical to SEQ ID NO: 12686

SEQ ID NO: 58346 - protein, 81 aa, Equus caballus; identical to SEQ ID NO: 12700

SEQ ID NO: 58347 - protein, 81 aa, Loxodonta africana; identical to SEQ ID NO: 12731

SEQ ID NO: 58348 - protein, 81 aa, Chrysochloris asiatica; identical to SEQ ID NO: 12740

SEQ ID NO: 58349 - protein, 81 aa, Nomascus leucogenys; identical to SEQ ID NO: 12762

SEQ ID NO: 58350 - protein, 81 aa, Capra hircus; identical to SEQ ID NO: 12781

SEQ ID NO: 58351 - protein, 81 aa, Suricata suricatta; identical to SEQ ID NO: 12791

SEQ ID NO: 58352 - protein, 81 aa, Capra hircus; identical to SEQ ID NO: 12820

SEQ ID NO: 58353 - protein, 81 aa, Sus scrofa; identical to SEQ ID NO: 12845

SEQ ID NO: 58354 - protein, 81 aa, Chlorocebus sabaeus; identical to SEQ ID NO: 12868

SEQ ID NO: 58355 - protein, 81 aa, Mandrillus leucophaeus; identical to SEQ ID NO: 12872

SEQ ID NO: 58356 - protein, 81 aa, Neophocaena asiaeorientalis asiaeorientalis; identical to SEQ ID NO: 12879

SEQ ID NO: 58357 - protein, 81 aa, Sus scrofa; identical to SEQ ID NO: 12915

SEQ ID NO: 58358 - protein, 81 aa, Canis lupus familiaris; identical to SEQ ID NO: 12932

SEQ ID NO: 58359 - protein, 81 aa, Mandrillus leucophaeus; identical to SEQ ID NO: 12944

SEQ ID NO: 58360 - protein, 81 aa, Nomascus leucogenys; identical to SEQ ID NO: 12970

SEQ ID NO: 58361 - protein, 81 aa, Canis lupus familiaris; identical to SEQ ID NO: 12977

SEQ ID NO: 58362 - protein, 81 aa, Canis lupus familiaris; identical to SEQ ID NO: 12981

SEQ ID NO: 58363 - protein, 81 aa, Muntiacus muntjak; identical to SEQ ID NO: 12984

SEQ ID NO: 58364 - protein, 81 aa, Mandrillus leucophaeus; identical to SEQ ID NO: 12987

SEQ ID NO: 58365 - protein, 81 aa, Canis lupus familiaris; identical to SEQ ID NO: 13027

SEQ ID NO: 58366 - protein, 81 aa, Sus scrofa; identical to SEQ ID NO: 13042

SEQ ID NO: 58367 - protein, 81 aa, Mandrillus leucophaeus; identical to SEQ ID NO: 13044

SEQ ID NO: 58368 - protein, 81 aa, Neophocaena asiaeorientalis asiaeorientalis; identical to SEQ ID NO: 13047

SEQ ID NO: 58369 - protein, 81 aa, Neophocaena asiaeorientalis asiaeorientalis; identical to SEQ ID NO: 13052

SEQ ID NO: 58370 - protein, 81 aa, Bos indicus; identical to SEQ ID NO: 13063

SEQ ID NO: 58371 - protein, 81 aa, Canis lupus familiaris; identical to SEQ ID NO: 13069

SEQ ID NO: 58372 - protein, 81 aa, Muntiacus muntjak; identical to SEQ ID NO: 13107

SEQ ID NO: 58373 - protein, 81 aa, Canis lupus familiaris; identical to SEQ ID NO: 13115

SEQ ID NO: 58374 - protein, 81 aa, Canis lupus familiaris; identical to SEQ ID NO: 13118

SEQ ID NO: 58375 - protein, 81 aa, Mandrillus leucophaeus; identical to SEQ ID NO: 13120

SEQ ID NO: 58376 - protein, 81 aa, Canis lupus familiaris; identical to SEQ ID NO: 13140

SEQ ID NO: 58377 - protein, 81 aa, Muntiacus muntjak; identical to SEQ ID NO: 13170

SEQ ID NO: 58378 - protein, 81 aa, Muntiacus muntjak; identical to SEQ ID NO: 13176

SEQ ID NO: 58379 - protein, 81 aa, Muntiacus muntjak; identical to SEQ ID NO: 13198

SEQ ID NO: 58380 - protein, 81 aa, Bos mutus; identical to SEQ ID NO: 13211

SEQ ID NO: 58381 - protein, 81 aa, Neophocaena asiaeorientalis asiaeorientalis; identical to SEQ ID NO: 13233

SEQ ID NO: 58382 - protein, 81 aa, Canis lupus familiaris; identical to SEQ ID NO: 13252

SEQ ID NO: 58383 - protein, 81 aa, Canis lupus familiaris; identical to SEQ ID NO: 13258

SEQ ID NO: 58384 - protein, 81 aa, Neophocaena asiaeorientalis asiaeorientalis; identical to SEQ ID NO: 13266

SEQ ID NO: 58385 - protein, 81 aa, Nomascus leucogenys; identical to SEQ ID NO: 13277

SEQ ID NO: 58386 - protein, 81 aa, Canis lupus familiaris; identical to SEQ ID NO: 13306

SEQ ID NO: 58387 - protein, 81 aa, Muntiacus muntjak; identical to SEQ ID NO: 13310

SEQ ID NO: 58388 - protein, 81 aa, Canis lupus familiaris; identical to SEQ ID NO: 13314

SEQ ID NO: 58389 - protein, 81 aa, Bos mutus; identical to SEQ ID NO: 13325

SEQ ID NO: 58390 - protein, 81 aa, Bos indicus; identical to SEQ ID NO: 13329

SEQ ID NO: 58391 - protein, 81 aa, Muntiacus muntjak; identical to SEQ ID NO: 13333

SEQ ID NO: 58392 - protein, 81 aa, Nomascus leucogenys; identical to SEQ ID NO: 13350

SEQ ID NO: 58393 - protein, 81 aa, Neophocaena asiaeorientalis asiaeorientalis; identical to SEQ ID NO: 13380

SEQ ID NO: 58394 - protein, 81 aa, Gorilla gorilla; identical to SEQ ID NO: 13404

SEQ ID NO: 58395 - protein, 81 aa, Bos indicus; identical to SEQ ID NO: 13432

SEQ ID NO: 58396 - protein, 81 aa, Muntiacus muntjak; identical to SEQ ID NO: 13439

SEQ ID NO: 58397 - protein, 81 aa, Nomascus leucogenys; identical to SEQ ID NO: 13484

SEQ ID NO: 58398 - protein, 81 aa, Ailuropoda melanoleuca; identical to SEQ ID NO: 13514

SEQ ID NO: 58399 - protein, 81 aa, Bos indicus; identical to SEQ ID NO: 13578

SEQ ID NO: 58400 - protein, 81 aa, Ailuropoda melanoleuca; identical to SEQ ID NO: 13582

SEQ ID NO: 58401 - protein, 81 aa, Gorilla gorilla; identical to SEQ ID NO: 13586

SEQ ID NO: 58402 - protein, 81 aa, Muntiacus muntjak; identical to SEQ ID NO: 13617

SEQ ID NO: 58403 - protein, 81 aa, Muntiacus muntjak; identical to SEQ ID NO: 13618

SEQ ID NO: 58404 - protein, 81 aa, Gorilla gorilla; identical to SEQ ID NO: 13627

SEQ ID NO: 58405 - protein, 81 aa, Gorilla gorilla; identical to SEQ ID NO: 13630

SEQ ID NO: 58406 - protein, 81 aa, Lynx canadensis; identical to SEQ ID NO: 13636

SEQ ID NO: 58407 - protein, 81 aa, Gorilla gorilla; identical to SEQ ID NO: 13663

SEQ ID NO: 58408 - protein, 81 aa, Ailuropoda melanoleuca; identical to SEQ ID NO: 13669

SEQ ID NO: 58409 - protein, 81 aa, Gorilla gorilla; identical to SEQ ID NO: 13695

SEQ ID NO: 58410 - protein, 81 aa, Bos indicus; identical to SEQ ID NO: 13709

SEQ ID NO: 58411 - protein, 81 aa, Bos indicus; identical to SEQ ID NO: 13710

SEQ ID NO: 58412 - protein, 81 aa, Muntiacus muntjak; identical to SEQ ID NO: 13717

SEQ ID NO: 58413 - protein, 81 aa, Muntiacus muntjak; identical to SEQ ID NO: 13718

SEQ ID NO: 58414 - protein, 81 aa, Macaca fascicularis; identical to SEQ ID NO: 13749

SEQ ID NO: 58415 - protein, 81 aa, Myotis lucifugus; identical to SEQ ID NO: 13765

SEQ ID NO: 58416 - protein, 81 aa, Phascolarctos cinereus; identical to SEQ ID NO: 13805

SEQ ID NO: 58417 - protein, 81 aa, Phascolarctos cinereus; identical to SEQ ID NO: 13817

SEQ ID NO: 58418 - protein, 81 aa, Myotis lucifugus; identical to SEQ ID NO: 13823

SEQ ID NO: 58419 - protein, 81 aa, Puma concolor; identical to SEQ ID NO: 13831

SEQ ID NO: 58420 - protein, 81 aa, Lynx canadensis; identical to SEQ ID NO: 13847

SEQ ID NO: 58421 - protein, 81 aa, Phyllostomus discolor; identical to SEQ ID NO: 13853

SEQ ID NO: 58422 - protein, 81 aa, Oryctolagus cuniculus; identical to SEQ ID NO: 13874

SEQ ID NO: 58423 - protein, 81 aa, Desmodus rotundus; identical to SEQ ID NO: 13883

SEQ ID NO: 58424 - protein, 81 aa, Macaca fascicularis; identical to SEQ ID NO: 13888

SEQ ID NO: 58425 - protein, 81 aa, Phascolarctos cinereus; identical to SEQ ID NO: 13896

SEQ ID NO: 58426 - protein, 81 aa, Phascolarctos cinereus; identical to SEQ ID NO: 13899

SEQ ID NO: 58427 - protein, 81 aa, Sapajus apella; identical to SEQ ID NO: 13920

SEQ ID NO: 58428 - protein, 81 aa, Macaca fascicularis; identical to SEQ ID NO: 13930

SEQ ID NO: 58429 - protein, 81 aa, Macaca fascicularis; identical to SEQ ID NO: 13934

SEQ ID NO: 58430 - protein, 81 aa, Macaca fascicularis; identical to SEQ ID NO: 13937

SEQ ID NO: 58431 - protein, 81 aa, Phascolarctos cinereus; identical to SEQ ID NO: 13948

SEQ ID NO: 58432 - protein, 81 aa, Phascolarctos cinereus; identical to SEQ ID NO: 13950

SEQ ID NO: 58433 - protein, 81 aa, Oryctolagus cuniculus; identical to SEQ ID NO: 13958

SEQ ID NO: 58434 - protein, 81 aa, Muntiacus muntjak; identical to SEQ ID NO: 13968

SEQ ID NO: 58435 - protein, 81 aa, Macaca fascicularis; identical to SEQ ID NO: 14015

SEQ ID NO: 58436 - protein, 81 aa, Macaca fascicularis; identical to SEQ ID NO: 14020

SEQ ID NO: 58437 - protein, 81 aa, Macaca fascicularis; identical to SEQ ID NO: 14021

SEQ ID NO: 58438 - protein, 81 aa, Puma concolor; identical to SEQ ID NO: 14031

SEQ ID NO: 58439 - protein, 81 aa, Phyllostomus discolor; identical to SEQ ID NO: 14060

SEQ ID NO: 58440 - protein, 81 aa, Phascolarctos cinereus; identical to SEQ ID NO: 14104

SEQ ID NO: 58441 - protein, 81 aa, Macaca fascicularis; identical to SEQ ID NO: 14123

SEQ ID NO: 58442 - protein, 81 aa, Phascolarctos cinereus; identical to SEQ ID NO: 14141

SEQ ID NO: 58443 - protein, 81 aa, Myotis lucifugus; identical to SEQ ID NO: 14148

SEQ ID NO: 58444 - protein, 81 aa, Ursus maritimus; identical to SEQ ID NO: 14181

SEQ ID NO: 58445 - protein, 81 aa, Ailuropoda melanoleuca; identical to SEQ ID NO: 14187

SEQ ID NO: 58446 - protein, 81 aa, Sapajus apella; identical to SEQ ID NO: 14208

SEQ ID NO: 58447 - protein, 81 aa, Ailuropoda melanoleuca; identical to SEQ ID NO: 14230

SEQ ID NO: 58448 - protein, 81 aa, Macaca fascicularis; identical to SEQ ID NO: 14240

SEQ ID NO: 58449 - protein, 81 aa, Macaca fascicularis; identical to SEQ ID NO: 14244

SEQ ID NO: 58450 - protein, 81 aa, Phascolarctos cinereus; identical to SEQ ID NO: 14290

SEQ ID NO: 58451 - protein, 81 aa, Sapajus apella; identical to SEQ ID NO: 14312

SEQ ID NO: 58452 - protein, 81 aa, Oryctolagus cuniculus; identical to SEQ ID NO: 14346

SEQ ID NO: 58453 - protein, 81 aa, Desmodus rotundus; identical to SEQ ID NO: 14388

SEQ ID NO: 58454 - protein, 81 aa, Macaca fascicularis; identical to SEQ ID NO: 14396

SEQ ID NO: 58455 - protein, 81 aa, Phascolarctos cinereus; identical to SEQ ID NO: 14401

SEQ ID NO: 58456 - protein, 81 aa, Phascolarctos cinereus; identical to SEQ ID NO: 14403

SEQ ID NO: 58457 - protein, 81 aa, Myotis lucifugus; identical to SEQ ID NO: 14412

SEQ ID NO: 58458 - protein, 81 aa, Macaca fascicularis; identical to SEQ ID NO: 14444

SEQ ID NO: 58459 - protein, 81 aa, Phascolarctos cinereus; identical to SEQ ID NO: 14451

SEQ ID NO: 58460 - protein, 81 aa, Phascolarctos cinereus; identical to SEQ ID NO: 14452

SEQ ID NO: 58461 - protein, 81 aa, Puma concolor; identical to SEQ ID NO: 14458

SEQ ID NO: 58462 - protein, 81 aa, Oryctolagus cuniculus; identical to SEQ ID NO: 14465

SEQ ID NO: 58463 - protein, 81 aa, Phyllostomus discolor; identical to SEQ ID NO: 14482

SEQ ID NO: 58464 - protein, 81 aa, Macaca fascicularis; identical to SEQ ID NO: 14483

SEQ ID NO: 58465 - protein, 81 aa, Phascolarctos cinereus; identical to SEQ ID NO: 14498

SEQ ID NO: 58466 - protein, 81 aa, Myotis lucifugus; identical to SEQ ID NO: 14499

SEQ ID NO: 58467 - protein, 81 aa, Sapajus apella; identical to SEQ ID NO: 14506

SEQ ID NO: 58468 - protein, 81 aa, Ailuropoda melanoleuca; identical to SEQ ID NO: 14536

SEQ ID NO: 58469 - protein, 81 aa, Sapajus apella; identical to SEQ ID NO: 14558

SEQ ID NO: 58470 - protein, 81 aa, Phascolarctos cinereus; identical to SEQ ID NO: 14589

SEQ ID NO: 58471 - protein, 81 aa, Puma concolor; identical to SEQ ID NO: 14605

SEQ ID NO: 58472 - protein, 81 aa, Macaca fascicularis; identical to SEQ ID NO: 14620

SEQ ID NO: 58473 - protein, 81 aa, Phascolarctos cinereus; identical to SEQ ID NO: 14628

SEQ ID NO: 58474 - protein, 81 aa, Phascolarctos cinereus; identical to SEQ ID NO: 14635

SEQ ID NO: 58475 - protein, 81 aa, Gorilla gorilla; identical to SEQ ID NO: 14655

SEQ ID NO: 58476 - protein, 81 aa, Ailuropoda melanoleuca; identical to SEQ ID NO: 14656

SEQ ID NO: 58477 - protein, 81 aa, Phascolarctos cinereus; identical to SEQ ID NO: 14681

SEQ ID NO: 58478 - protein, 81 aa, Phascolarctos cinereus; identical to SEQ ID NO: 14684

SEQ ID NO: 58479 - protein, 81 aa, Puma concolor; identical to SEQ ID NO: 14693

SEQ ID NO: 58480 - protein, 81 aa, Lynx canadensis; identical to SEQ ID NO: 14710

SEQ ID NO: 58481 - protein, 81 aa, Macaca fascicularis; identical to SEQ ID NO: 14720

SEQ ID NO: 58482 - protein, 81 aa, Phascolarctos cinereus; identical to SEQ ID NO: 14728

SEQ ID NO: 58483 - protein, 81 aa, Phascolarctos cinereus; identical to SEQ ID NO: 14729

SEQ ID NO: 58484 - protein, 81 aa, Phascolarctos cinereus; identical to SEQ ID NO: 14763

SEQ ID NO: 58485 - protein, 81 aa, Oryctolagus cuniculus; identical to SEQ ID NO: 14767

SEQ ID NO: 58486 - protein, 81 aa, Ailuropoda melanoleuca; identical to SEQ ID NO: 14769

SEQ ID NO: 58487 - protein, 81 aa, Macaca fascicularis; identical to SEQ ID NO: 14783

SEQ ID NO: 58488 - protein, 81 aa, Phascolarctos cinereus; identical to SEQ ID NO: 14789

SEQ ID NO: 58489 - protein, 81 aa, Sapajus apella; identical to SEQ ID NO: 14809

SEQ ID NO: 58490 - protein, 81 aa, Sapajus apella; identical to SEQ ID NO: 14810

SEQ ID NO: 58491 - protein, 81 aa, Lynx canadensis; identical to SEQ ID NO: 14822

SEQ ID NO: 58492 - protein, 81 aa, Phyllostomus discolor; identical to SEQ ID NO: 14824

SEQ ID NO: 58493 - protein, 81 aa, Phascolarctos cinereus; identical to SEQ ID NO: 14841

SEQ ID NO: 58494 - protein, 81 aa, Phascolarctos cinereus; identical to SEQ ID NO: 14842

SEQ ID NO: 58495 - protein, 81 aa, Sapajus apella; identical to SEQ ID NO: 14852

SEQ ID NO: 58496 - protein, 81 aa, Macaca fascicularis; identical to SEQ ID NO: 14902

SEQ ID NO: 58497 - protein, 81 aa, Lynx canadensis; identical to SEQ ID NO: 14924

SEQ ID NO: 58498 - protein, 81 aa, Macaca fascicularis; identical to SEQ ID NO: 14942

SEQ ID NO: 58499 - protein, 81 aa, Phascolarctos cinereus; identical to SEQ ID NO: 14949

SEQ ID NO: 58500 - protein, 81 aa, Phascolarctos cinereus; identical to SEQ ID NO: 14951

SEQ ID NO: 58501 - protein, 81 aa, Phascolarctos cinereus; identical to SEQ ID NO: 14962

SEQ ID NO: 58502 - protein, 81 aa, Canis lupus familiaris; identical to SEQ ID NO: 14970

SEQ ID NO: 58503 - protein, 81 aa, Macaca fascicularis; identical to SEQ ID NO: 14978

SEQ ID NO: 58504 - protein, 81 aa, Ailuropoda melanoleuca; identical to SEQ ID NO: 14997

SEQ ID NO: 58505 - protein, 81 aa, Lynx canadensis; identical to SEQ ID NO: 14999

SEQ ID NO: 58506 - protein, 81 aa, Phascolarctos cinereus; identical to SEQ ID NO: 15026

SEQ ID NO: 58507 - protein, 81 aa, Bos mutus; identical to SEQ ID NO: 15029

SEQ ID NO: 58508 - protein, 81 aa, Muntiacus muntjak; identical to SEQ ID NO: 15034

SEQ ID NO: 58509 - protein, 81 aa, Phascolarctos cinereus; identical to SEQ ID NO: 15077

SEQ ID NO: 58510 - protein, 81 aa, Lynx canadensis; identical to SEQ ID NO: 15089

SEQ ID NO: 58511 - protein, 81 aa, Macaca fascicularis; identical to SEQ ID NO: 15098

SEQ ID NO: 58512 - protein, 81 aa, Phascolarctos cinereus; identical to SEQ ID NO: 15100

SEQ ID NO: 58513 - protein, 81 aa, Phascolarctos cinereus; identical to SEQ ID NO: 15103

SEQ ID NO: 58514 - protein, 81 aa, Myotis lucifugus; identical to SEQ ID NO: 15106

SEQ ID NO: 58515 - protein, 81 aa, Puma concolor; identical to SEQ ID NO: 15116

SEQ ID NO: 58516 - protein, 81 aa, Ailuropoda melanoleuca; identical to SEQ ID NO: 15128

SEQ ID NO: 58517 - protein, 81 aa, Ailuropoda melanoleuca; identical to SEQ ID NO: 15132

SEQ ID NO: 58518 - protein, 81 aa, Phyllostomus discolor; identical to SEQ ID NO: 15150

SEQ ID NO: 58519 - protein, 81 aa, Phascolarctos cinereus; identical to SEQ ID NO: 15159

SEQ ID NO: 58520 - protein, 81 aa, Phascolarctos cinereus; identical to SEQ ID NO: 15160

SEQ ID NO: 58521 - protein, 81 aa, Phascolarctos cinereus; identical to SEQ ID NO: 15168

SEQ ID NO: 58522 - protein, 81 aa, Lynx canadensis; identical to SEQ ID NO: 15188

SEQ ID NO: 58523 - protein, 81 aa, Phyllostomus discolor; identical to SEQ ID NO: 15201

SEQ ID NO: 58524 - protein, 81 aa, Phyllostomus discolor; identical to SEQ ID NO: 15202

SEQ ID NO: 58525 - protein, 81 aa, Canis lupus familiaris; identical to SEQ ID NO: 15227

SEQ ID NO: 58526 - protein, 81 aa, Lynx canadensis; identical to SEQ ID NO: 15248

SEQ ID NO: 58527 - protein, 81 aa, Bos mutus; identical to SEQ ID NO: 15254

SEQ ID NO: 58528 - protein, 81 aa, Canis lupus familiaris; identical to SEQ ID NO: 15266

SEQ ID NO: 58529 - protein, 81 aa, Muntiacus muntjak; identical to SEQ ID NO: 15272

SEQ ID NO: 58530 - protein, 81 aa, Muntiacus muntjak; identical to SEQ ID NO: 15316

SEQ ID NO: 58531 - protein, 81 aa, Ailuropoda melanoleuca; identical to SEQ ID NO: 15338

SEQ ID NO: 58532 - protein, 81 aa, Lynx canadensis; identical to SEQ ID NO: 15345

SEQ ID NO: 58533 - protein, 81 aa, Lynx canadensis; identical to SEQ ID NO: 15347

SEQ ID NO: 58534 - protein, 81 aa, Lynx canadensis; identical to SEQ ID NO: 15375

SEQ ID NO: 58535 - protein, 81 aa, Bos indicus; identical to SEQ ID NO: 15406

SEQ ID NO: 58536 - protein, 81 aa, Muntiacus muntjak; identical to SEQ ID NO: 15414

SEQ ID NO: 58537 - protein, 81 aa, Desmodus rotundus; identical to SEQ ID NO: 15441

SEQ ID NO: 58538 - protein, 81 aa, Muntiacus muntjak; identical to SEQ ID NO: 15456

SEQ ID NO: 58539 - protein, 81 aa, Ailuropoda melanoleuca; identical to SEQ ID NO: 15457

SEQ ID NO: 58540 - protein, 81 aa, Lynx canadensis; identical to SEQ ID NO: 15477

SEQ ID NO: 58541 - protein, 81 aa, Desmodus rotundus; identical to SEQ ID NO: 15484

SEQ ID NO: 58542 - protein, 81 aa, Macaca fascicularis; identical to SEQ ID NO: 15492

SEQ ID NO: 58543 - protein, 81 aa, Phascolarctos cinereus; identical to SEQ ID NO: 15501

SEQ ID NO: 58544 - protein, 81 aa, Phyllostomus discolor; identical to SEQ ID NO: 15563

SEQ ID NO: 58545 - protein, 81 aa, Ailuropoda melanoleuca; identical to SEQ ID NO: 15606

SEQ ID NO: 58546 - protein, 81 aa, Ailuropoda melanoleuca; identical to SEQ ID NO: 15645

SEQ ID NO: 58547 - protein, 81 aa, Lynx canadensis; identical to SEQ ID NO: 15651

SEQ ID NO: 58548 - protein, 81 aa, Lynx canadensis; identical to SEQ ID NO: 15653

SEQ ID NO: 58549 - protein, 81 aa, Muntiacus muntjak; identical to SEQ ID NO: 15665

SEQ ID NO: 58550 - protein, 81 aa, Ailuropoda melanoleuca; identical to SEQ ID NO: 15670

SEQ ID NO: 58551 - protein, 81 aa, Lynx canadensis; identical to SEQ ID NO: 15676

SEQ ID NO: 58552 - protein, 81 aa, Gorilla gorilla; identical to SEQ ID NO: 15693

SEQ ID NO: 58553 - protein, 81 aa, Ailuropoda melanoleuca; identical to SEQ ID NO: 15695

SEQ ID NO: 58554 - protein, 81 aa, Gorilla gorilla; identical to SEQ ID NO: 15721

SEQ ID NO: 58555 - protein, 81 aa, Acinonyx jubatus; identical to SEQ ID NO: 15746

SEQ ID NO: 58556 - protein, 81 aa, Macaca mulatta; identical to SEQ ID NO: 15758

SEQ ID NO: 58557 - protein, 81 aa, Odocoileus virginianus texanus; identical to SEQ ID NO: 15833

SEQ ID NO: 58558 - protein, 81 aa, Odocoileus virginianus texanus; identical to SEQ ID NO: 15865

SEQ ID NO: 58559 - protein, 81 aa, Sapajus apella; identical to SEQ ID NO: 15892

SEQ ID NO: 58560 - protein, 81 aa, Acinonyx jubatus; identical to SEQ ID NO: 15913

SEQ ID NO: 58561 - protein, 81 aa, Rhinopithecus roxellana; identical to SEQ ID NO: 15914

SEQ ID NO: 58562 - protein, 81 aa, Rhinopithecus roxellana; identical to SEQ ID NO: 15919

SEQ ID NO: 58563 - protein, 81 aa, Cebus imitator; identical to SEQ ID NO: 15934

SEQ ID NO: 58564 - protein, 81 aa, Callithrix jacchus; identical to SEQ ID NO: 15939

SEQ ID NO: 58565 - protein, 81 aa, Rhinopithecus roxellana; identical to SEQ ID NO: 15948

SEQ ID NO: 58566 - protein, 81 aa, Cebus imitator; identical to SEQ ID NO: 15964

SEQ ID NO: 58567 - protein, 81 aa, Cebus imitator; identical to SEQ ID NO: 15968

SEQ ID NO: 58568 - protein, 81 aa, Callithrix jacchus; identical to SEQ ID NO: 15981

SEQ ID NO: 58569 - protein, 81 aa, Macaca mulatta; identical to SEQ ID NO: 15983

SEQ ID NO: 58570 - protein, 81 aa, Cebus imitator; identical to SEQ ID NO: 16004

SEQ ID NO: 58571 - protein, 81 aa, Bos taurus; identical to SEQ ID NO: 16020

SEQ ID NO: 58572 - protein, 81 aa, Rhinopithecus roxellana; identical to SEQ ID NO: 16024

SEQ ID NO: 58573 - protein, 81 aa, Callithrix jacchus; identical to SEQ ID NO: 16047

SEQ ID NO: 58574 - protein, 81 aa, Callorhinus ursinus; identical to SEQ ID NO: 16058

SEQ ID NO: 58575 - protein, 81 aa, Acinonyx jubatus; identical to SEQ ID NO: 16065

SEQ ID NO: 58576 - protein, 81 aa, Acinonyx jubatus; identical to SEQ ID NO: 16067

SEQ ID NO: 58577 - protein, 81 aa, Sapajus apella; identical to SEQ ID NO: 16093

SEQ ID NO: 58578 - protein, 81 aa, Sapajus apella; identical to SEQ ID NO: 16096

SEQ ID NO: 58579 - protein, 81 aa, Acinonyx jubatus; identical to SEQ ID NO: 16097

SEQ ID NO: 58580 - protein, 81 aa, Rhinopithecus roxellana; identical to SEQ ID NO: 16102

SEQ ID NO: 58581 - protein, 81 aa, Bison bison bison; identical to SEQ ID NO: 16113

SEQ ID NO: 58582 - protein, 81 aa, Cebus imitator; identical to SEQ ID NO: 16114

SEQ ID NO: 58583 - protein, 81 aa, Ovis aries; identical to SEQ ID NO: 16161

SEQ ID NO: 58584 - protein, 81 aa, Callithrix jacchus; identical to SEQ ID NO: 16189

SEQ ID NO: 58585 - protein, 81 aa, Ovis aries; identical to SEQ ID NO: 16202

SEQ ID NO: 58586 - protein, 81 aa, Ovis aries; identical to SEQ ID NO: 16205

SEQ ID NO: 58587 - protein, 81 aa, Vulpes vulpes; identical to SEQ ID NO: 16208

SEQ ID NO: 58588 - protein, 81 aa, Acinonyx jubatus; identical to SEQ ID NO: 16221

SEQ ID NO: 58589 - protein, 81 aa, Bison bison bison; identical to SEQ ID NO: 16222

SEQ ID NO: 58590 - protein, 81 aa, Callithrix jacchus; identical to SEQ ID NO: 16238

SEQ ID NO: 58591 - protein, 81 aa, Ovis aries; identical to SEQ ID NO: 16256

SEQ ID NO: 58592 - protein, 81 aa, Vulpes vulpes; identical to SEQ ID NO: 16257

SEQ ID NO: 58593 - protein, 81 aa, Ovis aries; identical to SEQ ID NO: 16278

SEQ ID NO: 58594 - protein, 81 aa, Vulpes vulpes; identical to SEQ ID NO: 16290

SEQ ID NO: 58595 - protein, 81 aa, Vulpes vulpes; identical to SEQ ID NO: 16293

SEQ ID NO: 58596 - protein, 81 aa, Acinonyx jubatus; identical to SEQ ID NO: 16303

SEQ ID NO: 58597 - protein, 81 aa, Acinonyx jubatus; identical to SEQ ID NO: 16316

SEQ ID NO: 58598 - protein, 81 aa, Rhinopithecus roxellana; identical to SEQ ID NO: 16346

SEQ ID NO: 58599 - protein, 81 aa, Rhinopithecus roxellana; identical to SEQ ID NO: 16352

SEQ ID NO: 58600 - protein, 81 aa, Acinonyx jubatus; identical to SEQ ID NO: 16353

SEQ ID NO: 58601 - protein, 81 aa, Odocoileus virginianus texanus; identical to SEQ ID NO: 16360

SEQ ID NO: 58602 - protein, 81 aa, Callithrix jacchus; identical to SEQ ID NO: 16370

SEQ ID NO: 58603 - protein, 81 aa, Callithrix jacchus; identical to SEQ ID NO: 16373

SEQ ID NO: 58604 - protein, 81 aa, Ovis aries; identical to SEQ ID NO: 16386

SEQ ID NO: 58605 - protein, 81 aa, Ovis aries; identical to SEQ ID NO: 16388

SEQ ID NO: 58606 - protein, 81 aa, Callithrix jacchus; identical to SEQ ID NO: 16397

SEQ ID NO: 58607 - protein, 81 aa, Callithrix jacchus; identical to SEQ ID NO: 16398

SEQ ID NO: 58608 - protein, 81 aa, Cebus imitator; identical to SEQ ID NO: 16471

SEQ ID NO: 58609 - protein, 81 aa, Tursiops truncatus; identical to SEQ ID NO: 16473

SEQ ID NO: 58610 - protein, 81 aa, Acinonyx jubatus; identical to SEQ ID NO: 16475

SEQ ID NO: 58611 - protein, 81 aa, Neophocaena asiaeorientalis asiaeorientalis; identical to SEQ ID NO: 16479

SEQ ID NO: 58612 - protein, 81 aa, Pongo abelii; identical to SEQ ID NO: 16482

SEQ ID NO: 58613 - protein, 81 aa, Leptonychotes weddellii; identical to SEQ ID NO: 16510

SEQ ID NO: 58614 - protein, 81 aa, Pan troglodytes; identical to SEQ ID NO: 16525

SEQ ID NO: 58615 - protein, 81 aa, Rhinopithecus roxellana; identical to SEQ ID NO: 16538

SEQ ID NO: 58616 - protein, 81 aa, Odocoileus virginianus texanus; identical to SEQ ID NO: 16545

SEQ ID NO: 58617 - protein, 81 aa, Rhinopithecus roxellana; identical to SEQ ID NO: 16566

SEQ ID NO: 58618 - protein, 81 aa, Bison bison bison; identical to SEQ ID NO: 16570

SEQ ID NO: 58619 - protein, 81 aa, Balaenoptera acutorostrata scammoni; identical to SEQ ID NO: 16646

SEQ ID NO: 58620 - protein, 81 aa, Cebus imitator; identical to SEQ ID NO: 16655

SEQ ID NO: 58621 - protein, 81 aa, Callithrix jacchus; identical to SEQ ID NO: 16659

SEQ ID NO: 58622 - protein, 81 aa, Callithrix jacchus; identical to SEQ ID NO: 16694

SEQ ID NO: 58623 - protein, 81 aa, Callithrix jacchus; identical to SEQ ID NO: 16696

SEQ ID NO: 58624 - protein, 81 aa, Callorhinus ursinus; identical to SEQ ID NO: 16700

SEQ ID NO: 58625 - protein, 81 aa, Callorhinus ursinus; identical to SEQ ID NO: 16705

SEQ ID NO: 58626 - protein, 81 aa, Cebus imitator; identical to SEQ ID NO: 16722

SEQ ID NO: 58627 - protein, 81 aa, Cebus imitator; identical to SEQ ID NO: 16724

SEQ ID NO: 58628 - protein, 81 aa, Delphinapterus leucas; identical to SEQ ID NO: 16753

SEQ ID NO: 58629 - protein, 81 aa, Pan troglodytes; identical to SEQ ID NO: 16755

SEQ ID NO: 58630 - protein, 81 aa, Sapajus apella; identical to SEQ ID NO: 16757

SEQ ID NO: 58631 - protein, 81 aa, Callorhinus ursinus; identical to SEQ ID NO: 16788

SEQ ID NO: 58632 - protein, 81 aa, Cebus imitator; identical to SEQ ID NO: 16806

SEQ ID NO: 58633 - protein, 81 aa, Cebus imitator; identical to SEQ ID NO: 16807

SEQ ID NO: 58634 - protein, 81 aa, Macaca mulatta; identical to SEQ ID NO: 16812

SEQ ID NO: 58635 - protein, 81 aa, Bos taurus; identical to SEQ ID NO: 16818

SEQ ID NO: 58636 - protein, 81 aa, Ovis aries; identical to SEQ ID NO: 16872

SEQ ID NO: 58637 - protein, 81 aa, Ovis aries; identical to SEQ ID NO: 16878

SEQ ID NO: 58638 - protein, 81 aa, Otolemur garnettii; identical to SEQ ID NO: 16883

SEQ ID NO: 58639 - protein, 81 aa, Otolemur garnettii; identical to SEQ ID NO: 16919

SEQ ID NO: 58640 - protein, 81 aa, Macaca mulatta; identical to SEQ ID NO: 16933

SEQ ID NO: 58641 - protein, 81 aa, Ovis aries; identical to SEQ ID NO: 16942

SEQ ID NO: 58642 - protein, 81 aa, Otolemur garnettii; identical to SEQ ID NO: 16953

SEQ ID NO: 58643 - protein, 81 aa, Callithrix jacchus; identical to SEQ ID NO: 16958

SEQ ID NO: 58644 - protein, 81 aa, Vulpes vulpes; identical to SEQ ID NO: 16982

SEQ ID NO: 58645 - protein, 81 aa, Ovis aries; identical to SEQ ID NO: 17050

SEQ ID NO: 58646 - protein, 81 aa, Enhydra lutris kenyoni; identical to SEQ ID NO: 17059

SEQ ID NO: 58647 - protein, 81 aa, Bos taurus; identical to SEQ ID NO: 17075

SEQ ID NO: 58648 - protein, 81 aa, Enhydra lutris kenyoni; identical to SEQ ID NO: 17091

SEQ ID NO: 58649 - protein, 81 aa, Zalophus californianus; identical to SEQ ID NO: 17128

SEQ ID NO: 58650 - protein, 81 aa, Delphinapterus leucas; identical to SEQ ID NO: 17130

SEQ ID NO: 58651 - protein, 81 aa, Ovis aries; identical to SEQ ID NO: 17136

SEQ ID NO: 58652 - protein, 81 aa, Rhinopithecus bieti; identical to SEQ ID NO: 17142

SEQ ID NO: 58653 - protein, 81 aa, Ovis aries; identical to SEQ ID NO: 17169

SEQ ID NO: 58654 - protein, 81 aa, Macaca mulatta; identical to SEQ ID NO: 17182

SEQ ID NO: 58655 - protein, 81 aa, Enhydra lutris kenyoni; identical to SEQ ID NO: 17203

SEQ ID NO: 58656 - protein, 81 aa, Bos taurus; identical to SEQ ID NO: 17234

SEQ ID NO: 58657 - protein, 81 aa, Ovis aries; identical to SEQ ID NO: 17242

SEQ ID NO: 58658 - protein, 81 aa, Pongo abelii; identical to SEQ ID NO: 17266

SEQ ID NO: 58659 - protein, 81 aa, Ovis aries; identical to SEQ ID NO: 17303

SEQ ID NO: 58660 - protein, 81 aa, Otolemur garnettii; identical to SEQ ID NO: 17307

SEQ ID NO: 58661 - protein, 81 aa, Pongo abelii; identical to SEQ ID NO: 17357

SEQ ID NO: 58662 - protein, 81 aa, Macaca mulatta; identical to SEQ ID NO: 17365

SEQ ID NO: 58663 - protein, 81 aa, Ovis aries; identical to SEQ ID NO: 17372

SEQ ID NO: 58664 - protein, 81 aa, Otolemur garnettii; identical to SEQ ID NO: 17385

SEQ ID NO: 58665 - protein, 81 aa, Otolemur garnettii; identical to SEQ ID NO: 17393

SEQ ID NO: 58666 - protein, 81 aa, Vicugna pacos; identical to SEQ ID NO: 17431

SEQ ID NO: 58667 - protein, 81 aa, Trichechus manatus latirostris; identical to SEQ ID NO: 17442

SEQ ID NO: 58668 - protein, 81 aa, Ovis aries; identical to SEQ ID NO: 17459

SEQ ID NO: 58669 - protein, 81 aa, Odocoileus virginianus texanus; identical to SEQ ID NO: 17491

SEQ ID NO: 58670 - protein, 81 aa, Callithrix jacchus; identical to SEQ ID NO: 17497

SEQ ID NO: 58671 - protein, 81 aa, Rhinopithecus roxellana; identical to SEQ ID NO: 17518

SEQ ID NO: 58672 - protein, 80 aa, Cebus imitator; identical to SEQ ID NO: 17527

SEQ ID NO: 58673 - protein, 81 aa, Cebus imitator; identical to SEQ ID NO: 17580

SEQ ID NO: 58674 - protein, 81 aa, Acinonyx jubatus; identical to SEQ ID NO: 17590

SEQ ID NO: 58675 - protein, 81 aa, Rhinopithecus roxellana; identical to SEQ ID NO: 17597

SEQ ID NO: 58676 - protein, 81 aa, Macaca mulatta; identical to SEQ ID NO: 17635

SEQ ID NO: 58677 - protein, 81 aa, Callithrix jacchus; identical to SEQ ID NO: 17636

SEQ ID NO: 58678 - protein, 81 aa, Acinonyx jubatus; identical to SEQ ID NO: 17653

SEQ ID NO: 58679 - protein, 81 aa, Rhinopithecus roxellana; identical to SEQ ID NO: 17675

SEQ ID NO: 58680 - protein, 81 aa, Odocoileus virginianus texanus; identical to SEQ ID NO: 17685

SEQ ID NO: 58681 - protein, 81 aa, Pan troglodytes; identical to SEQ ID NO: 17695

SEQ ID NO: 58682 - protein, 81 aa, Cebus imitator; identical to SEQ ID NO: 17716

SEQ ID NO: 58683 - protein, 81 aa, Papio anubis; identical to SEQ ID NO: 17730

SEQ ID NO: 58684 - protein, 81 aa, Ursus maritimus; identical to SEQ ID NO: 17737

SEQ ID NO: 58685 - protein, 81 aa, Cebus imitator; identical to SEQ ID NO: 17748

SEQ ID NO: 58686 - protein, 81 aa, Cebus imitator; identical to SEQ ID NO: 17749

SEQ ID NO: 58687 - protein, 81 aa, Macaca nemestrina; identical to SEQ ID NO: 17757

SEQ ID NO: 58688 - protein, 81 aa, Physeter macrocephalus; identical to SEQ ID NO: 17767

SEQ ID NO: 58689 - protein, 81 aa, Delphinapterus leucas; identical to SEQ ID NO: 17770

SEQ ID NO: 58690 - protein, 81 aa, Leptonychotes weddellii; identical to SEQ ID NO: 17778

SEQ ID NO: 58691 - protein, 81 aa, Leptonychotes weddellii; identical to SEQ ID NO: 17783

SEQ ID NO: 58692 - protein, 81 aa, Phascolarctos cinereus; identical to SEQ ID NO: 17792

SEQ ID NO: 58693 - protein, 81 aa, Pongo abelii; identical to SEQ ID NO: 17796

SEQ ID NO: 58694 - protein, 81 aa, Callorhinus ursinus; identical to SEQ ID NO: 17813

SEQ ID NO: 58695 - protein, 81 aa, Callorhinus ursinus; identical to SEQ ID NO: 17814

SEQ ID NO: 58696 - protein, 81 aa, Tursiops truncatus; identical to SEQ ID NO: 17815

SEQ ID NO: 58697 - protein, 81 aa, Phascolarctos cinereus; identical to SEQ ID NO: 17822

SEQ ID NO: 58698 - protein, 81 aa, Ursus arctos horribilis; identical to SEQ ID NO: 17850

SEQ ID NO: 58699 - protein, 81 aa, Leptonychotes weddellii; identical to SEQ ID NO: 17853

SEQ ID NO: 58700 - protein, 81 aa, Pan troglodytes; identical to SEQ ID NO: 17857

SEQ ID NO: 58701 - protein, 81 aa, Enhydra lutris kenyoni; identical to SEQ ID NO: 17863

SEQ ID NO: 58702 - protein, 81 aa, Monodelphis domestica; identical to SEQ ID NO: 17882

SEQ ID NO: 58703 - protein, 81 aa, Saimiri boliviensis boliviensis; identical to SEQ ID NO: 17890

SEQ ID NO: 58704 - protein, 81 aa, Balaenoptera acutorostrata scammoni; identical to SEQ ID NO: 17892

SEQ ID NO: 58705 - protein, 81 aa, Callorhinus ursinus; identical to SEQ ID NO: 17895

SEQ ID NO: 58706 - protein, 81 aa, Delphinapterus leucas; identical to SEQ ID NO: 17928

SEQ ID NO: 58707 - protein, 81 aa, Balaenoptera acutorostrata scammoni; identical to SEQ ID NO: 17930

SEQ ID NO: 58708 - protein, 81 aa, Ursus maritimus; identical to SEQ ID NO: 17975

SEQ ID NO: 58709 - protein, 81 aa, Papio anubis; identical to SEQ ID NO: 17984

SEQ ID NO: 58710 - protein, 81 aa, Callorhinus ursinus; identical to SEQ ID NO: 17995

SEQ ID NO: 58711 - protein, 81 aa, Rhinolophus ferrumequinum; identical to SEQ ID NO: 17996

SEQ ID NO: 58712 - protein, 81 aa, Rhinopithecus roxellana; identical to SEQ ID NO: 18055

SEQ ID NO: 58713 - protein, 81 aa, Callorhinus ursinus; identical to SEQ ID NO: 18072

SEQ ID NO: 58714 - protein, 81 aa, Delphinapterus leucas; identical to SEQ ID NO: 18092

SEQ ID NO: 58715 - protein, 81 aa, Odocoileus virginianus texanus; identical to SEQ ID NO: 18113

SEQ ID NO: 58716 - protein, 81 aa, Rhinolophus ferrumequinum; identical to SEQ ID NO: 18120

SEQ ID NO: 58717 - protein, 81 aa, Sapajus apella; identical to SEQ ID NO: 18142

SEQ ID NO: 58718 - protein, 81 aa, Balaenoptera acutorostrata scammoni; identical to SEQ ID NO: 18146

SEQ ID NO: 58719 - protein, 81 aa, Rhinopithecus roxellana; identical to SEQ ID NO: 18160

SEQ ID NO: 58720 - protein, 81 aa, Rhinopithecus roxellana; identical to SEQ ID NO: 18181

SEQ ID NO: 58721 - protein, 81 aa, Macaca mulatta; identical to SEQ ID NO: 18224

SEQ ID NO: 58722 - protein, 81 aa, Phyllostomus discolor; identical to SEQ ID NO: 18227

SEQ ID NO: 58723 - protein, 81 aa, Panthera pardus; identical to SEQ ID NO: 18253

SEQ ID NO: 58724 - protein, 81 aa, Ursus arctos horribilis; identical to SEQ ID NO: 18258

SEQ ID NO: 58725 - protein, 81 aa, Ursus arctos horribilis; identical to SEQ ID NO: 18272

SEQ ID NO: 58726 - protein, 81 aa, Ursus maritimus; identical to SEQ ID NO: 18286

SEQ ID NO: 58727 - protein, 81 aa, Physeter macrocephalus; identical to SEQ ID NO: 18296

SEQ ID NO: 58728 - protein, 81 aa, Zalophus californianus; identical to SEQ ID NO: 18299

SEQ ID NO: 58729 - protein, 81 aa, Ursus maritimus; identical to SEQ ID NO: 18314

SEQ ID NO: 58730 - protein, 81 aa, Ursus arctos horribilis; identical to SEQ ID NO: 18321

SEQ ID NO: 58731 - protein, 81 aa, Pteropus vampyrus; identical to SEQ ID NO: 18325

SEQ ID NO: 58732 - protein, 81 aa, Delphinapterus leucas; identical to SEQ ID NO: 18353

SEQ ID NO: 58733 - protein, 81 aa, Rhinolophus ferrumequinum; identical to SEQ ID NO: 18355

SEQ ID NO: 58734 - protein, 81 aa, Muntiacus muntjak; identical to SEQ ID NO: 18360

SEQ ID NO: 58735 - protein, 81 aa, Vicugna pacos; identical to SEQ ID NO: 18383

SEQ ID NO: 58736 - protein, 81 aa, Tursiops truncatus; identical to SEQ ID NO: 18397

SEQ ID NO: 58737 - protein, 81 aa, Bison bison bison; identical to SEQ ID NO: 18398

SEQ ID NO: 58738 - protein, 81 aa, Camelus dromedarius; identical to SEQ ID NO: 18452

SEQ ID NO: 58739 - protein, 81 aa, Leptonychotes weddellii; identical to SEQ ID NO: 18459

SEQ ID NO: 58740 - protein, 81 aa, Leptonychotes weddellii; identical to SEQ ID NO: 18501

SEQ ID NO: 58741 - protein, 81 aa, Leptonychotes weddellii; identical to SEQ ID NO: 18502

SEQ ID NO: 58742 - protein, 81 aa, Ovis aries; identical to SEQ ID NO: 18531

SEQ ID NO: 58743 - protein, 81 aa, Vulpes vulpes; identical to SEQ ID NO: 18540

SEQ ID NO: 58744 - protein, 81 aa, Monodelphis domestica; identical to SEQ ID NO: 18593

SEQ ID NO: 58745 - protein, 81 aa, Cercocebus atys; identical to SEQ ID NO: 18602

SEQ ID NO: 58746 - protein, 81 aa, Neomonachus schauinslandi; identical to SEQ ID NO: 18614

SEQ ID NO: 58747 - protein, 81 aa, Monodelphis domestica; identical to SEQ ID NO: 18616

SEQ ID NO: 58748 - protein, 81 aa, Physeter macrocephalus; identical to SEQ ID NO: 18628

SEQ ID NO: 58749 - protein, 81 aa, Monodelphis domestica; identical to SEQ ID NO: 18635

SEQ ID NO: 58750 - protein, 81 aa, Myotis davidii; identical to SEQ ID NO: 18644

SEQ ID NO: 58751 - protein, 81 aa, Cercocebus atys; identical to SEQ ID NO: 18653

SEQ ID NO: 58752 - protein, 81 aa, Neomonachus schauinslandi; identical to SEQ ID NO: 18666

SEQ ID NO: 58753 - protein, 81 aa, Neomonachus schauinslandi; identical to SEQ ID NO: 18667

SEQ ID NO: 58754 - protein, 81 aa, Cercocebus atys; identical to SEQ ID NO: 18693

SEQ ID NO: 58755 - protein, 81 aa, Monodelphis domestica; identical to SEQ ID NO: 18751

SEQ ID NO: 58756 - protein, 81 aa, Monodelphis domestica; identical to SEQ ID NO: 18777

SEQ ID NO: 58757 - protein, 81 aa, Monodelphis domestica; identical to SEQ ID NO: 18781

SEQ ID NO: 58758 - protein, 81 aa, Monodelphis domestica; identical to SEQ ID NO: 18785

SEQ ID NO: 58759 - protein, 81 aa, Monodelphis domestica; identical to SEQ ID NO: 18790

SEQ ID NO: 58760 - protein, 81 aa, Cercocebus atys; identical to SEQ ID NO: 18808

SEQ ID NO: 58761 - protein, 81 aa, Neomonachus schauinslandi; identical to SEQ ID NO: 18823

SEQ ID NO: 58762 - protein, 81 aa, Monodelphis domestica; identical to SEQ ID NO: 18833

SEQ ID NO: 58763 - protein, 81 aa, Physeter macrocephalus; identical to SEQ ID NO: 18836

SEQ ID NO: 58764 - protein, 81 aa, Leptonychotes weddellii; identical to SEQ ID NO: 18867

SEQ ID NO: 58765 - protein, 81 aa, Leptonychotes weddellii; identical to SEQ ID NO: 18871

SEQ ID NO: 58766 - protein, 81 aa, Camelus dromedarius; identical to SEQ ID NO: 18894

SEQ ID NO: 58767 - protein, 81 aa, Pongo abelii; identical to SEQ ID NO: 18917

SEQ ID NO: 58768 - protein, 81 aa, Pongo abelii; identical to SEQ ID NO: 18920

SEQ ID NO: 58769 - protein, 81 aa, Leptonychotes weddellii; identical to SEQ ID NO: 18990

SEQ ID NO: 58770 - protein, 81 aa, Leptonychotes weddellii; identical to SEQ ID NO: 18992

SEQ ID NO: 58771 - protein, 81 aa, Cercocebus atys; identical to SEQ ID NO: 19009

SEQ ID NO: 58772 - protein, 81 aa, Enhydra lutris kenyoni; identical to SEQ ID NO: 19017

SEQ ID NO: 58773 - protein, 81 aa, Pongo abelii; identical to SEQ ID NO: 19022

SEQ ID NO: 58774 - protein, 81 aa, Otolemur garnettii; identical to SEQ ID NO: 19044

SEQ ID NO: 58775 - protein, 81 aa, Aotus trivirgatus; identical to SEQ ID NO: 19167

SEQ ID NO: 58776 - protein, 81 aa, Papio anubis; identical to SEQ ID NO: 19202

SEQ ID NO: 58777 - protein, 81 aa, Neomonachus schauinslandi; identical to SEQ ID NO: 19219

SEQ ID NO: 58778 - protein, 81 aa, Monodelphis domestica; identical to SEQ ID NO: 19222

SEQ ID NO: 58779 - protein, 81 aa, Monodelphis domestica; identical to SEQ ID NO: 19255

SEQ ID NO: 58780 - protein, 81 aa, Sarcophilus harrisii; identical to SEQ ID NO: 19274

SEQ ID NO: 58781 - protein, 81 aa, Cercocebus atys; identical to SEQ ID NO: 19280

SEQ ID NO: 58782 - protein, 81 aa, Physeter macrocephalus; identical to SEQ ID NO: 19300

SEQ ID NO: 58783 - protein, 81 aa, Monodelphis domestica; identical to SEQ ID NO: 19322

SEQ ID NO: 58784 - protein, 81 aa, Monodelphis domestica; identical to SEQ ID NO: 19325

SEQ ID NO: 58785 - protein, 81 aa, Physeter macrocephalus; identical to SEQ ID NO: 19333

SEQ ID NO: 58786 - protein, 81 aa, Aotus trivirgatus; identical to SEQ ID NO: 19346

SEQ ID NO: 58787 - protein, 81 aa, Leptonychotes weddellii; identical to SEQ ID NO: 19360

SEQ ID NO: 58788 - protein, 81 aa, Felis catus; identical to SEQ ID NO: 19362

SEQ ID NO: 58789 - protein, 81 aa, Leptonychotes weddellii; identical to SEQ ID NO: 19363

SEQ ID NO: 58790 - protein, 81 aa, Neomonachus schauinslandi; identical to SEQ ID NO: 19391

SEQ ID NO: 58791 - protein, 81 aa, Monodelphis domestica; identical to SEQ ID NO: 19422

SEQ ID NO: 58792 - protein, 81 aa, Monodelphis domestica; identical to SEQ ID NO: 19431

SEQ ID NO: 58793 - protein, 81 aa, Monodelphis domestica; identical to SEQ ID NO: 19442

SEQ ID NO: 58794 - protein, 81 aa, Monodelphis domestica; identical to SEQ ID NO: 19444

SEQ ID NO: 58795 - protein, 81 aa, Monodelphis domestica; identical to SEQ ID NO: 19451

SEQ ID NO: 58796 - protein, 81 aa, Monodelphis domestica; identical to SEQ ID NO: 19464

SEQ ID NO: 58797 - protein, 81 aa, Monodelphis domestica; identical to SEQ ID NO: 19475

SEQ ID NO: 58798 - protein, 81 aa, Neomonachus schauinslandi; identical to SEQ ID NO: 19504

SEQ ID NO: 58799 - protein, 81 aa, Neomonachus schauinslandi; identical to SEQ ID NO: 19534

SEQ ID NO: 58800 - protein, 81 aa, Physeter macrocephalus; identical to SEQ ID NO: 19543

SEQ ID NO: 58801 - protein, 81 aa, Physeter macrocephalus; identical to SEQ ID NO: 19545

SEQ ID NO: 58802 - protein, 81 aa, Physeter macrocephalus; identical to SEQ ID NO: 19547

SEQ ID NO: 58803 - protein, 81 aa, Aotus trivirgatus; identical to SEQ ID NO: 19552

SEQ ID NO: 58804 - protein, 81 aa, Felis catus; identical to SEQ ID NO: 19560

SEQ ID NO: 58805 - protein, 81 aa, Monodelphis domestica; identical to SEQ ID NO: 19577

SEQ ID NO: 58806 - protein, 81 aa, Monodelphis domestica; identical to SEQ ID NO: 19578

SEQ ID NO: 58807 - protein, 81 aa, Monodelphis domestica; identical to SEQ ID NO: 19602

SEQ ID NO: 58808 - protein, 81 aa, Monodelphis domestica; identical to SEQ ID NO: 19604

SEQ ID NO: 58809 - protein, 81 aa, Aotus trivirgatus; identical to SEQ ID NO: 19617

SEQ ID NO: 58810 - protein, 81 aa, Myotis davidii; identical to SEQ ID NO: 19621

SEQ ID NO: 58811 - protein, 81 aa, Cercocebus atys; identical to SEQ ID NO: 19623

SEQ ID NO: 58812 - protein, 81 aa, Camelus dromedarius; identical to SEQ ID NO: 19655

SEQ ID NO: 58813 - protein, 81 aa, Cercocebus atys; identical to SEQ ID NO: 19699

SEQ ID NO: 58814 - protein, 81 aa, Neomonachus schauinslandi; identical to SEQ ID NO: 19708

SEQ ID NO: 58815 - protein, 81 aa, Monodelphis domestica; identical to SEQ ID NO: 19713

SEQ ID NO: 58816 - protein, 81 aa, Physeter macrocephalus; identical to SEQ ID NO: 19737

SEQ ID NO: 58817 - protein, 81 aa, Monodelphis domestica; identical to SEQ ID NO: 19765

SEQ ID NO: 58818 - protein, 81 aa, Neomonachus schauinslandi; identical to SEQ ID NO: 19789

SEQ ID NO: 58819 - protein, 81 aa, Monodelphis domestica; identical to SEQ ID NO: 19796

SEQ ID NO: 58820 - protein, 81 aa, Camelus dromedarius; identical to SEQ ID NO: 19812

SEQ ID NO: 58821 - protein, 81 aa, Felis catus; identical to SEQ ID NO: 19817

SEQ ID NO: 58822 - protein, 81 aa, Vulpes vulpes; identical to SEQ ID NO: 19830

SEQ ID NO: 58823 - protein, 81 aa, Pan troglodytes; identical to SEQ ID NO: 19843

SEQ ID NO: 58824 - protein, 81 aa, Myotis davidii; identical to SEQ ID NO: 19845

SEQ ID NO: 58825 - protein, 81 aa, Monodelphis domestica; identical to SEQ ID NO: 19853

SEQ ID NO: 58826 - protein, 81 aa, Monodelphis domestica; identical to SEQ ID NO: 19871

SEQ ID NO: 58827 - protein, 81 aa, Monodelphis domestica; identical to SEQ ID NO: 19872

SEQ ID NO: 58828 - protein, 81 aa, Pan troglodytes; identical to SEQ ID NO: 19879

SEQ ID NO: 58829 - protein, 81 aa, Leptonychotes weddellii; identical to SEQ ID NO: 19904

SEQ ID NO: 58830 - protein, 81 aa, Monodelphis domestica; identical to SEQ ID NO: 19936

SEQ ID NO: 58831 - protein, 81 aa, Monodelphis domestica; identical to SEQ ID NO: 19949

SEQ ID NO: 58832 - protein, 81 aa, Camelus dromedarius; identical to SEQ ID NO: 19954

SEQ ID NO: 58833 - protein, 81 aa, Camelus dromedarius; identical to SEQ ID NO: 19992

SEQ ID NO: 58834 - protein, 81 aa, Pongo abelii; identical to SEQ ID NO: 20010

SEQ ID NO: 58835 - protein, 81 aa, Callithrix jacchus; identical to SEQ ID NO: 20042

SEQ ID NO: 58836 - protein, 81 aa, Ovis aries; identical to SEQ ID NO: 20054

SEQ ID NO: 58837 - protein, 81 aa, Enhydra lutris kenyoni; identical to SEQ ID NO: 20066

SEQ ID NO: 58838 - protein, 81 aa, Enhydra lutris kenyoni; identical to SEQ ID NO: 20090

SEQ ID NO: 58839 - protein, 81 aa, Pongo abelii; identical to SEQ ID NO: 20096

SEQ ID NO: 58840 - protein, 81 aa, Pongo abelii; identical to SEQ ID NO: 20098

SEQ ID NO: 58841 - protein, 81 aa, Enhydra lutris kenyoni; identical to SEQ ID NO: 20124

SEQ ID NO: 58842 - protein, 81 aa, Pongo abelii; identical to SEQ ID NO: 20147

SEQ ID NO: 58843 - protein, 81 aa, Bos indicus x Bos taurus; identical to SEQ ID NO: 20175

SEQ ID NO: 58844 - protein, 81 aa, Vulpes vulpes; identical to SEQ ID NO: 20191

SEQ ID NO: 58845 - protein, 81 aa, Otolemur garnettii; identical to SEQ ID NO: 20198

SEQ ID NO: 58846 - protein, 81 aa, Otolemur garnettii; identical to SEQ ID NO: 20244

SEQ ID NO: 58847 - protein, 81 aa, Enhydra lutris kenyoni; identical to SEQ ID NO: 20326

SEQ ID NO: 58848 - protein, 81 aa, Camelus dromedarius; identical to SEQ ID NO: 20339

SEQ ID NO: 58849 - protein, 81 aa, Camelus dromedarius; identical to SEQ ID NO: 20340

SEQ ID NO: 58850 - protein, 81 aa, Myotis davidii; identical to SEQ ID NO: 20418

SEQ ID NO: 58851 - protein, 81 aa, Pongo abelii; identical to SEQ ID NO: 20470

SEQ ID NO: 58852 - protein, 81 aa, Monodelphis domestica; identical to SEQ ID NO: 20504

SEQ ID NO: 58853 - protein, 81 aa, Monodelphis domestica; identical to SEQ ID NO: 20506

SEQ ID NO: 58854 - protein, 81 aa, Physeter macrocephalus; identical to SEQ ID NO: 20507

SEQ ID NO: 58855 - protein, 81 aa, Monodelphis domestica; identical to SEQ ID NO: 20523

SEQ ID NO: 58856 - protein, 81 aa, Monodelphis domestica; identical to SEQ ID NO: 20542

SEQ ID NO: 58857 - protein, 81 aa, Monodelphis domestica; identical to SEQ ID NO: 20543

SEQ ID NO: 58858 - protein, 81 aa, Aotus trivirgatus; identical to SEQ ID NO: 20556

SEQ ID NO: 58859 - protein, 81 aa, Monodelphis domestica; identical to SEQ ID NO: 20564

SEQ ID NO: 58860 - protein, 81 aa, Monodelphis domestica; identical to SEQ ID NO: 20566

SEQ ID NO: 58861 - protein, 81 aa, Monodelphis domestica; identical to SEQ ID NO: 20606

SEQ ID NO: 58862 - protein, 81 aa, Monodelphis domestica; identical to SEQ ID NO: 20616

SEQ ID NO: 58863 - protein, 81 aa, Monodelphis domestica; identical to SEQ ID NO: 20636

SEQ ID NO: 58864 - protein, 81 aa, Papio anubis; identical to SEQ ID NO: 20652

SEQ ID NO: 58865 - protein, 81 aa, Papio anubis; identical to SEQ ID NO: 20682

SEQ ID NO: 58866 - protein, 81 aa, Monodelphis domestica; identical to SEQ ID NO: 20699

SEQ ID NO: 58867 - protein, 81 aa, Monodelphis domestica; identical to SEQ ID NO: 20704

SEQ ID NO: 58868 - protein, 81 aa, Monodelphis domestica; identical to SEQ ID NO: 20715

SEQ ID NO: 58869 - protein, 81 aa, Monodelphis domestica; identical to SEQ ID NO: 20716

SEQ ID NO: 58870 - protein, 81 aa, Monodelphis domestica; identical to SEQ ID NO: 20719

SEQ ID NO: 58871 - protein, 81 aa, Physeter macrocephalus; identical to SEQ ID NO: 20721

SEQ ID NO: 58872 - protein, 81 aa, Lipotes vexillifer; identical to SEQ ID NO: 20730

SEQ ID NO: 58873 - protein, 81 aa, Monodelphis domestica; identical to SEQ ID NO: 20748

SEQ ID NO: 58874 - protein, 81 aa, Otolemur garnettii; identical to SEQ ID NO: 20818

SEQ ID NO: 58875 - protein, 81 aa, Bos indicus x Bos taurus; identical to SEQ ID NO: 20827

SEQ ID NO: 58876 - protein, 81 aa, Pan troglodytes; identical to SEQ ID NO: 20832

SEQ ID NO: 58877 - protein, 81 aa, Otolemur garnettii; identical to SEQ ID NO: 20840

SEQ ID NO: 58878 - protein, 81 aa, Enhydra lutris kenyoni; identical to SEQ ID NO: 20895

SEQ ID NO: 58879 - protein, 81 aa, Pongo abelii; identical to SEQ ID NO: 20896

SEQ ID NO: 58880 - protein, 81 aa, Pongo abelii; identical to SEQ ID NO: 20899

SEQ ID NO: 58881 - protein, 81 aa, Pan troglodytes; identical to SEQ ID NO: 20905

SEQ ID NO: 58882 - protein, 81 aa, Enhydra lutris kenyoni; identical to SEQ ID NO: 20907

SEQ ID NO: 58883 - protein, 81 aa, Zalophus californianus; identical to SEQ ID NO: 20919

SEQ ID NO: 58884 - protein, 81 aa, Rhinolophus ferrumequinum; identical to SEQ ID NO: 20924

SEQ ID NO: 58885 - protein, 81 aa, Rhinopithecus roxellana; identical to SEQ ID NO: 20937

SEQ ID NO: 58886 - protein, 81 aa, Zalophus californianus; identical to SEQ ID NO: 21002

SEQ ID NO: 58887 - protein, 81 aa, Panthera pardus; identical to SEQ ID NO: 21005

SEQ ID NO: 58888 - protein, 81 aa, Vicugna pacos; identical to SEQ ID NO: 21008

SEQ ID NO: 58889 - protein, 81 aa, Zalophus californianus; identical to SEQ ID NO: 21010

SEQ ID NO: 58890 - protein, 81 aa, Callorhinus ursinus; identical to SEQ ID NO: 21040

SEQ ID NO: 58891 - protein, 81 aa, Zalophus californianus; identical to SEQ ID NO: 21063

SEQ ID NO: 58892 - protein, 81 aa, Pan paniscus; identical to SEQ ID NO: 21066

SEQ ID NO: 58893 - protein, 81 aa, Tursiops truncatus; identical to SEQ ID NO: 21086

SEQ ID NO: 58894 - protein, 81 aa, Tursiops truncatus; identical to SEQ ID NO: 21087

SEQ ID NO: 58895 - protein, 81 aa, Panthera pardus; identical to SEQ ID NO: 21109

SEQ ID NO: 58896 - protein, 81 aa, Tursiops truncatus; identical to SEQ ID NO: 21112

SEQ ID NO: 58897 - protein, 81 aa, Leptonychotes weddellii; identical to SEQ ID NO: 21131

SEQ ID NO: 58898 - protein, 81 aa, Physeter macrocephalus; identical to SEQ ID NO: 21142

SEQ ID NO: 58899 - protein, 81 aa, Carlito syrichta; identical to SEQ ID NO: 21144

SEQ ID NO: 58900 - protein, 81 aa, Tursiops truncatus; identical to SEQ ID NO: 21149

SEQ ID NO: 58901 - protein, 81 aa, Panthera pardus; identical to SEQ ID NO: 21208

SEQ ID NO: 58902 - protein, 81 aa, Phascolarctos cinereus; identical to SEQ ID NO: 21214

SEQ ID NO: 58903 - protein, 81 aa, Physeter macrocephalus; identical to SEQ ID NO: 21234

SEQ ID NO: 58904 - protein, 81 aa, Acinonyx jubatus; identical to SEQ ID NO: 21253

SEQ ID NO: 58905 - protein, 81 aa, Sus scrofa; identical to SEQ ID NO: 21255

SEQ ID NO: 58906 - protein, 81 aa, Odocoileus virginianus texanus; identical to SEQ ID NO: 21266

SEQ ID NO: 58907 - protein, 81 aa, Trichechus manatus latirostris; identical to SEQ ID NO: 21290

SEQ ID NO: 58908 - protein, 81 aa, Pteropus vampyrus; identical to SEQ ID NO: 21327

SEQ ID NO: 58909 - protein, 81 aa, Vicugna pacos; identical to SEQ ID NO: 21368

SEQ ID NO: 58910 - protein, 81 aa, Phascolarctos cinereus; identical to SEQ ID NO: 21369

SEQ ID NO: 58911 - protein, 81 aa, Cercocebus atys; identical to SEQ ID NO: 21406

SEQ ID NO: 58912 - protein, 81 aa, Callithrix jacchus; identical to SEQ ID NO: 21437

SEQ ID NO: 58913 - protein, 81 aa, Callithrix jacchus; identical to SEQ ID NO: 21451

SEQ ID NO: 58914 - protein, 81 aa, Panthera pardus; identical to SEQ ID NO: 21455

SEQ ID NO: 58915 - protein, 81 aa, Cebus imitator; identical to SEQ ID NO: 21464

SEQ ID NO: 58916 - protein, 81 aa, Vicugna pacos; identical to SEQ ID NO: 21471

SEQ ID NO: 58917 - protein, 81 aa, Pteropus vampyrus; identical to SEQ ID NO: 21478

SEQ ID NO: 58918 - protein, 81 aa, Ursus arctos horribilis; identical to SEQ ID NO: 21490

SEQ ID NO: 58919 - protein, 81 aa, Saimiri boliviensis boliviensis; identical to SEQ ID NO: 21500

SEQ ID NO: 58920 - protein, 81 aa, Physeter macrocephalus; identical to SEQ ID NO: 21517

SEQ ID NO: 58921 - protein, 81 aa, Sus scrofa; identical to SEQ ID NO: 21555

SEQ ID NO: 58922 - protein, 81 aa, Nomascus leucogenys; identical to SEQ ID NO: 21574

SEQ ID NO: 58923 - protein, 81 aa, Trichechus manatus latirostris; identical to SEQ ID NO: 21581

SEQ ID NO: 58924 - protein, 81 aa, Equus caballus; identical to SEQ ID NO: 21588

SEQ ID NO: 58925 - protein, 81 aa, Mandrillus leucophaeus; identical to SEQ ID NO: 21606

SEQ ID NO: 58926 - protein, 81 aa, Nomascus leucogenys; identical to SEQ ID NO: 21643

SEQ ID NO: 58927 - protein, 81 aa, Chlorocebus sabaeus; identical to SEQ ID NO: 21656

SEQ ID NO: 58928 - protein, 81 aa, Mandrillus leucophaeus; identical to SEQ ID NO: 21659

SEQ ID NO: 58929 - protein, 81 aa, Sus scrofa; identical to SEQ ID NO: 21664

SEQ ID NO: 58930 - protein, 81 aa, Chrysochloris asiatica; identical to SEQ ID NO: 21680

SEQ ID NO: 58931 - protein, 81 aa, Suricata suricatta; identical to SEQ ID NO: 21684

SEQ ID NO: 58932 - protein, 81 aa, Sus scrofa; identical to SEQ ID NO: 21720

SEQ ID NO: 58933 - protein, 81 aa, Neophocaena asiaeorientalis asiaeorientalis; identical to SEQ ID NO: 21771

SEQ ID NO: 58934 - protein, 81 aa, Suricata suricatta; identical to SEQ ID NO: 21786

SEQ ID NO: 58935 - protein, 81 aa, Mandrillus leucophaeus; identical to SEQ ID NO: 21793

SEQ ID NO: 58936 - protein, 81 aa, Suricata suricatta; identical to SEQ ID NO: 21835

SEQ ID NO: 58937 - protein, 81 aa, Mandrillus leucophaeus; identical to SEQ ID NO: 21848

SEQ ID NO: 58938 - protein, 81 aa, Chrysochloris asiatica; identical to SEQ ID NO: 21865

SEQ ID NO: 58939 - protein, 81 aa, Sus scrofa; identical to SEQ ID NO: 21886

SEQ ID NO: 58940 - protein, 81 aa, Suricata suricatta; identical to SEQ ID NO: 21954

SEQ ID NO: 58941 - protein, 81 aa, Mandrillus leucophaeus; identical to SEQ ID NO: 22034

SEQ ID NO: 58942 - protein, 81 aa, Pan paniscus; identical to SEQ ID NO: 22117

SEQ ID NO: 58943 - protein, 81 aa, Equus caballus; identical to SEQ ID NO: 22129

SEQ ID NO: 58944 - protein, 81 aa, Sarcophilus harrisii; identical to SEQ ID NO: 22142

SEQ ID NO: 58945 - protein, 81 aa, Zalophus californianus; identical to SEQ ID NO: 22186

SEQ ID NO: 58946 - protein, 81 aa, Loxodonta africana; identical to SEQ ID NO: 22201

SEQ ID NO: 58947 - protein, 81 aa, Pteropus vampyrus; identical to SEQ ID NO: 22205

SEQ ID NO: 58948 - protein, 81 aa, Trichechus manatus latirostris; identical to SEQ ID NO: 22214

SEQ ID NO: 58949 - protein, 81 aa, Neovison vison; identical to SEQ ID NO: 22229

SEQ ID NO: 58950 - protein, 81 aa, Callorhinus ursinus; identical to SEQ ID NO: 22242

SEQ ID NO: 58951 - protein, 81 aa, Suricata suricatta; identical to SEQ ID NO: 22252

SEQ ID NO: 58952 - protein, 81 aa, Sarcophilus harrisii; identical to SEQ ID NO: 22280

SEQ ID NO: 58953 - protein, 81 aa, Sarcophilus harrisii; identical to SEQ ID NO: 22281

SEQ ID NO: 58954 - protein, 81 aa, Callorhinus ursinus; identical to SEQ ID NO: 22294

SEQ ID NO: 58955 - protein, 81 aa, Tursiops truncatus; identical to SEQ ID NO: 22316

SEQ ID NO: 58956 - protein, 81 aa, Sarcophilus harrisii; identical to SEQ ID NO: 22345

SEQ ID NO: 58957 - protein, 81 aa, Pteropus vampyrus; identical to SEQ ID NO: 22379

SEQ ID NO: 58958 - protein, 81 aa, Mandrillus leucophaeus; identical to SEQ ID NO: 22395

SEQ ID NO: 58959 - protein, 81 aa, Aotus trivirgatus; identical to SEQ ID NO: 22396

SEQ ID NO: 58960 - protein, 81 aa, Lipotes vexillifer; identical to SEQ ID NO: 22431

SEQ ID NO: 58961 - protein, 81 aa, Zalophus californianus; identical to SEQ ID NO: 22452

SEQ ID NO: 58962 - protein, 81 aa, Equus caballus; identical to SEQ ID NO: 22453

SEQ ID NO: 58963 - protein, 81 aa, Equus caballus; identical to SEQ ID NO: 22454

SEQ ID NO: 58964 - protein, 81 aa, Equus caballus; identical to SEQ ID NO: 22486

SEQ ID NO: 58965 - protein, 81 aa, Equus caballus; identical to SEQ ID NO: 22488

SEQ ID NO: 58966 - protein, 81 aa, Physeter macrocephalus; identical to SEQ ID NO: 22490

SEQ ID NO: 58967 - protein, 81 aa, Pteropus vampyrus; identical to SEQ ID NO: 22540

SEQ ID NO: 58968 - protein, 81 aa, Pan paniscus; identical to SEQ ID NO: 22600

SEQ ID NO: 58969 - protein, 81 aa, Tursiops truncatus; identical to SEQ ID NO: 22613

SEQ ID NO: 58970 - protein, 81 aa, Sarcophilus harrisii; identical to SEQ ID NO: 22702

SEQ ID NO: 58971 - protein, 81 aa, Callorhinus ursinus; identical to SEQ ID NO: 22707

SEQ ID NO: 58972 - protein, 81 aa, Aotus trivirgatus; identical to SEQ ID NO: 22731

SEQ ID NO: 58973 - protein, 81 aa, Monodelphis domestica; identical to SEQ ID NO: 22745

SEQ ID NO: 58974 - protein, 81 aa, Monodelphis domestica; identical to SEQ ID NO: 22751

SEQ ID NO: 58975 - protein, 81 aa, Monodelphis domestica; identical to SEQ ID NO: 22777

SEQ ID NO: 58976 - protein, 81 aa, Trichechus manatus latirostris; identical to SEQ ID NO: 22905

SEQ ID NO: 58977 - protein, 81 aa, Equus caballus; identical to SEQ ID NO: 22941

SEQ ID NO: 58978 - protein, 81 aa, Equus caballus; identical to SEQ ID NO: 22942

SEQ ID NO: 58979 - protein, 81 aa, Aotus trivirgatus; identical to SEQ ID NO: 22963

SEQ ID NO: 58980 - protein, 81 aa, Chlorocebus sabaeus; identical to SEQ ID NO: 22981

SEQ ID NO: 58981 - protein, 81 aa, Equus caballus; identical to SEQ ID NO: 23008

SEQ ID NO: 58982 - protein, 81 aa, Lipotes vexillifer; identical to SEQ ID NO: 23015

SEQ ID NO: 58983 - protein, 81 aa, Equus caballus; identical to SEQ ID NO: 23019

SEQ ID NO: 58984 - protein, 81 aa, Suricata suricatta; identical to SEQ ID NO: 23028

SEQ ID NO: 58985 - protein, 81 aa, Callorhinus ursinus; identical to SEQ ID NO: 23047

SEQ ID NO: 58986 - protein, 81 aa, Trichechus manatus latirostris; identical to SEQ ID NO: 23066

SEQ ID NO: 58987 - protein, 81 aa, Equus caballus; identical to SEQ ID NO: 23070

SEQ ID NO: 58988 - protein, 81 aa, Suricata suricatta; identical to SEQ ID NO: 23104

SEQ ID NO: 58989 - protein, 81 aa, Sarcophilus harrisii; identical to SEQ ID NO: 23107

SEQ ID NO: 58990 - protein, 81 aa, Lipotes vexillifer; identical to SEQ ID NO: 23112

SEQ ID NO: 58991 - protein, 81 aa, Tursiops truncatus; identical to SEQ ID NO: 23141

SEQ ID NO: 58992 - protein, 81 aa, Trichechus manatus latirostris; identical to SEQ ID NO: 23198

SEQ ID NO: 58993 - protein, 81 aa, Sarcophilus harrisii; identical to SEQ ID NO: 23236

SEQ ID NO: 58994 - protein, 81 aa, Pteropus vampyrus; identical to SEQ ID NO: 23262

SEQ ID NO: 58995 - protein, 81 aa, Trichechus manatus latirostris; identical to SEQ ID NO: 23270

SEQ ID NO: 58996 - protein, 81 aa, Lipotes vexillifer; identical to SEQ ID NO: 23277

SEQ ID NO: 58997 - protein, 81 aa, Trichechus manatus latirostris; identical to SEQ ID NO: 23285

SEQ ID NO: 58998 - protein, 81 aa, Trichechus manatus latirostris; identical to SEQ ID NO: 23311

SEQ ID NO: 58999 - protein, 81 aa, Pan paniscus; identical to SEQ ID NO: 23339

SEQ ID NO: 59000 - protein, 81 aa, Lipotes vexillifer; identical to SEQ ID NO: 23387

SEQ ID NO: 59001 - protein, 81 aa, Pteropus vampyrus; identical to SEQ ID NO: 23397

SEQ ID NO: 59002 - protein, 81 aa, Pteropus vampyrus; identical to SEQ ID NO: 23399

SEQ ID NO: 59003 - protein, 81 aa, Trichechus manatus latirostris; identical to SEQ ID NO: 23404

SEQ ID NO: 59004 - protein, 81 aa, Sarcophilus harrisii; identical to SEQ ID NO: 23416

SEQ ID NO: 59005 - protein, 81 aa, Monodelphis domestica; identical to SEQ ID NO: 23430

SEQ ID NO: 59006 - protein, 81 aa, Tursiops truncatus; identical to SEQ ID NO: 23441

SEQ ID NO: 59007 - protein, 81 aa, Aotus trivirgatus; identical to SEQ ID NO: 23485

SEQ ID NO: 59008 - protein, 81 aa, Tursiops truncatus; identical to SEQ ID NO: 23494

SEQ ID NO: 59009 - protein, 81 aa, Tursiops truncatus; identical to SEQ ID NO: 23500

SEQ ID NO: 59010 - protein, 81 aa, Pteropus vampyrus; identical to SEQ ID NO: 23502

SEQ ID NO: 59011 - protein, 81 aa, Aotus trivirgatus; identical to SEQ ID NO: 23526

SEQ ID NO: 59012 - protein, 81 aa, Aotus trivirgatus; identical to SEQ ID NO: 23544

SEQ ID NO: 59013 - protein, 81 aa, Callorhinus ursinus; identical to SEQ ID NO: 23549

SEQ ID NO: 59014 - protein, 81 aa, Monodelphis domestica; identical to SEQ ID NO: 23573

SEQ ID NO: 59015 - protein, 81 aa, Monodelphis domestica; identical to SEQ ID NO: 23577

SEQ ID NO: 59016 - protein, 81 aa, Monodelphis domestica; identical to SEQ ID NO: 23578

SEQ ID NO: 59017 - protein, 81 aa, Monodelphis domestica; identical to SEQ ID NO: 23581

SEQ ID NO: 59018 - protein, 81 aa, Papio anubis; identical to SEQ ID NO: 23590

SEQ ID NO: 59019 - protein, 81 aa, Aotus trivirgatus; identical to SEQ ID NO: 23598

SEQ ID NO: 59020 - protein, 81 aa, Aotus trivirgatus; identical to SEQ ID NO: 23602

SEQ ID NO: 59021 - protein, 81 aa, Callorhinus ursinus; identical to SEQ ID NO: 23614

SEQ ID NO: 59022 - protein, 81 aa, Aotus trivirgatus; identical to SEQ ID NO: 23631

SEQ ID NO: 59023 - protein, 81 aa, Lipotes vexillifer; identical to SEQ ID NO: 23637

SEQ ID NO: 59024 - protein, 81 aa, Callorhinus ursinus; identical to SEQ ID NO: 23639

SEQ ID NO: 59025 - protein, 81 aa, Tursiops truncatus; identical to SEQ ID NO: 23646

SEQ ID NO: 59026 - protein, 81 aa, Papio anubis; identical to SEQ ID NO: 23685

SEQ ID NO: 59027 - protein, 81 aa, Nomascus leucogenys; identical to SEQ ID NO: 23705

SEQ ID NO: 59028 - protein, 81 aa, Homo sapiens; identical to SEQ ID NO: 837

SEQ ID NO: 59029 - protein, 81 aa, Ursus arctos horribilis; identical to SEQ ID NO: 23773

SEQ ID NO: 59030 - protein, 81 aa, Saimiri boliviensis boliviensis; identical to SEQ ID NO: 23786

SEQ ID NO: 59031 - protein, 81 aa, Balaenoptera acutorostrata scammoni; identical to SEQ ID NO: 23788

SEQ ID NO: 59032 - protein, 81 aa, Propithecus coquereli; identical to SEQ ID NO: 23811

SEQ ID NO: 59033 - protein, 81 aa, Propithecus coquereli; identical to SEQ ID NO: 23829

SEQ ID NO: 59034 - protein, 81 aa, Panthera pardus; identical to SEQ ID NO: 23859

SEQ ID NO: 59035 - protein, 81 aa, Panthera pardus; identical to SEQ ID NO: 23861

SEQ ID NO: 59036 - protein, 81 aa, Ursus maritimus; identical to SEQ ID NO: 23887

SEQ ID NO: 59037 - protein, 81 aa, Ursus americanus; identical to SEQ ID NO: 23890

SEQ ID NO: 59038 - protein, 81 aa, Propithecus coquereli; identical to SEQ ID NO: 23895

SEQ ID NO: 59039 - protein, 81 aa, Saimiri boliviensis boliviensis; identical to SEQ ID NO: 23897

SEQ ID NO: 59040 - protein, 81 aa, Vombatus ursinus; identical to SEQ ID NO: 23901

SEQ ID NO: 59041 - protein, 81 aa, Cervus elaphus hippelaphus; identical to SEQ ID NO: 24036

SEQ ID NO: 59042 - protein, 81 aa, Colobus angolensis palliatus; identical to SEQ ID NO: 24038

SEQ ID NO: 59043 - protein, 81 aa, Tupaia chinensis; identical to SEQ ID NO: 24047

SEQ ID NO: 59044 - protein, 81 aa, Ursus arctos horribilis; identical to SEQ ID NO: 24056

SEQ ID NO: 59045 - protein, 81 aa, Muntiacus reevesi; identical to SEQ ID NO: 24058

SEQ ID NO: 59046 - protein, 81 aa, Muntiacus reevesi; identical to SEQ ID NO: 24063

SEQ ID NO: 59047 - protein, 81 aa, Lynx pardinus; identical to SEQ ID NO: 24126

SEQ ID NO: 59048 - protein, 81 aa, Saimiri boliviensis boliviensis; identical to SEQ ID NO: 24128

SEQ ID NO: 59049 - protein, 81 aa, Cervus elaphus hippelaphus; identical to SEQ ID NO: 24130

SEQ ID NO: 59050 - protein, 81 aa, Cervus elaphus hippelaphus; identical to SEQ ID NO: 24131

SEQ ID NO: 59051 - protein, 81 aa, Cervus elaphus hippelaphus; identical to SEQ ID NO: 24132

SEQ ID NO: 59052 - protein, 81 aa, Colobus angolensis palliatus; identical to SEQ ID NO: 24137

SEQ ID NO: 59053 - protein, 81 aa, Saimiri boliviensis boliviensis; identical to SEQ ID NO: 24158

SEQ ID NO: 59054 - protein, 81 aa, Saimiri boliviensis boliviensis; identical to SEQ ID NO: 24159

SEQ ID NO: 59055 - protein, 81 aa, Vombatus ursinus; identical to SEQ ID NO: 24160

SEQ ID NO: 59056 - protein, 81 aa, Balaenoptera acutorostrata scammoni; identical to SEQ ID NO: 24169

SEQ ID NO: 59057 - protein, 81 aa, Mustela putorius furo; identical to SEQ ID NO: 24201

SEQ ID NO: 59058 - protein, 81 aa, Propithecus coquereli; identical to SEQ ID NO: 24212

SEQ ID NO: 59059 - protein, 81 aa, Mustela putorius furo; identical to SEQ ID NO: 24228

SEQ ID NO: 59060 - protein, 81 aa, Camelus ferus; identical to SEQ ID NO: 24232

SEQ ID NO: 59061 - protein, 81 aa, Vicugna pacos; identical to SEQ ID NO: 24255

SEQ ID NO: 59062 - protein, 81 aa, Colobus angolensis palliatus; identical to SEQ ID NO: 24300

SEQ ID NO: 59063 - protein, 81 aa, Odobenus rosmarus divergens; identical to SEQ ID NO: 24315

SEQ ID NO: 59064 - protein, 81 aa, Ursus americanus; identical to SEQ ID NO: 24319

SEQ ID NO: 59065 - protein, 81 aa, Vombatus ursinus; identical to SEQ ID NO: 24334

SEQ ID NO: 59066 - protein, 81 aa, Vombatus ursinus; identical to SEQ ID NO: 24336

SEQ ID NO: 59067 - protein, 81 aa, Vicugna pacos; identical to SEQ ID NO: 24358

SEQ ID NO: 59068 - protein, 81 aa, Delphinapterus leucas; identical to SEQ ID NO: 24369

SEQ ID NO: 59069 - protein, 81 aa, Tupaia chinensis; identical to SEQ ID NO: 24379

SEQ ID NO: 59070 - protein, 81 aa, Colobus angolensis palliatus; identical to SEQ ID NO: 24400

SEQ ID NO: 59071 - protein, 81 aa, Mustela putorius furo; identical to SEQ ID NO: 24405

SEQ ID NO: 59072 - protein, 81 aa, Gulo gulo; identical to SEQ ID NO: 24420

SEQ ID NO: 59073 - protein, 81 aa, Erinaceus europaeus; identical to SEQ ID NO: 24442

SEQ ID NO: 59074 - protein, 81 aa, Carlito syrichta; identical to SEQ ID NO: 24450

SEQ ID NO: 59075 - protein, 81 aa, Carlito syrichta; identical to SEQ ID NO: 24455

SEQ ID NO: 59076 - protein, 81 aa, Carlito syrichta; identical to SEQ ID NO: 24460

SEQ ID NO: 59077 - protein, 81 aa, Vicugna pacos; identical to SEQ ID NO: 24494

SEQ ID NO: 59078 - protein, 81 aa, Odobenus rosmarus divergens; identical to SEQ ID NO: 24497

SEQ ID NO: 59079 - protein, 81 aa, Gulo gulo; identical to SEQ ID NO: 24538

SEQ ID NO: 59080 - protein, 81 aa, Carlito syrichta; identical to SEQ ID NO: 24572

SEQ ID NO: 59081 - protein, 81 aa, Carlito syrichta; identical to SEQ ID NO: 24573

SEQ ID NO: 59082 - protein, 81 aa, Vicugna pacos; identical to SEQ ID NO: 24577

SEQ ID NO: 59083 - protein, 81 aa, Odobenus rosmarus divergens; identical to SEQ ID NO: 24599

SEQ ID NO: 59084 - protein, 81 aa, Mustela putorius furo; identical to SEQ ID NO: 24613

SEQ ID NO: 59085 - protein, 81 aa, Mustela putorius furo; identical to SEQ ID NO: 24627

SEQ ID NO: 59086 - protein, 81 aa, Tupaia chinensis; identical to SEQ ID NO: 24632

SEQ ID NO: 59087 - protein, 81 aa, Odobenus rosmarus divergens; identical to SEQ ID NO: 24633

SEQ ID NO: 59088 - protein, 81 aa, Colobus angolensis palliatus; identical to SEQ ID NO: 24680

SEQ ID NO: 59089 - protein, 81 aa, Gulo gulo; identical to SEQ ID NO: 24693

SEQ ID NO: 59090 - protein, 81 aa, Erinaceus europaeus; identical to SEQ ID NO: 24694

SEQ ID NO: 59091 - protein, 81 aa, Erinaceus europaeus; identical to SEQ ID NO: 24695

SEQ ID NO: 59092 - protein, 81 aa, Odobenus rosmarus divergens; identical to SEQ ID NO: 24709

SEQ ID NO: 59093 - protein, 81 aa, Vicugna pacos; identical to SEQ ID NO: 24723

SEQ ID NO: 59094 - protein, 81 aa, Carlito syrichta; identical to SEQ ID NO: 24760

SEQ ID NO: 59095 - protein, 81 aa, Delphinapterus leucas; identical to SEQ ID NO: 24761

SEQ ID NO: 59096 - protein, 81 aa, Carlito syrichta; identical to SEQ ID NO: 24773

SEQ ID NO: 59097 - protein, 81 aa, Tupaia chinensis; identical to SEQ ID NO: 24798

SEQ ID NO: 59098 - protein, 81 aa, Vicugna pacos; identical to SEQ ID NO: 24799

SEQ ID NO: 59099 - protein, 81 aa, Carlito syrichta; identical to SEQ ID NO: 24828

SEQ ID NO: 59100 - protein, 81 aa, Gulo gulo; identical to SEQ ID NO: 24830

SEQ ID NO: 59101 - protein, 81 aa, Carlito syrichta; identical to SEQ ID NO: 24840

SEQ ID NO: 59102 - protein, 81 aa, Colobus angolensis palliatus; identical to SEQ ID NO: 24850

SEQ ID NO: 59103 - protein, 81 aa, Myotis brandtii; identical to SEQ ID NO: 24864

SEQ ID NO: 59104 - protein, 81 aa, Odobenus rosmarus divergens; identical to SEQ ID NO: 24912

SEQ ID NO: 59105 - protein, 81 aa, Colobus angolensis palliatus; identical to SEQ ID NO: 24923

SEQ ID NO: 59106 - protein, 81 aa, Odobenus rosmarus divergens; identical to SEQ ID NO: 24946

SEQ ID NO: 59107 - protein, 81 aa, Gulo gulo; identical to SEQ ID NO: 24973

SEQ ID NO: 59108 - protein, 81 aa, Erinaceus europaeus; identical to SEQ ID NO: 24975

SEQ ID NO: 59109 - protein, 81 aa, Mustela putorius furo; identical to SEQ ID NO: 24982

SEQ ID NO: 59110 - protein, 81 aa, Colobus angolensis palliatus; identical to SEQ ID NO: 25004

SEQ ID NO: 59111 - protein, 81 aa, Mustela putorius furo; identical to SEQ ID NO: 25014

SEQ ID NO: 59112 - protein, 81 aa, Mustela putorius furo; identical to SEQ ID NO: 25017

SEQ ID NO: 59113 - protein, 81 aa, Odobenus rosmarus divergens; identical to SEQ ID NO: 25035

SEQ ID NO: 59114 - protein, 81 aa, Gulo gulo; identical to SEQ ID NO: 25050

SEQ ID NO: 59115 - protein, 81 aa, Homo sapiens; identical to SEQ ID NO: 867

SEQ ID NO: 59116 - protein, 81 aa, Muntiacus reevesi; identical to SEQ ID NO: 25072

SEQ ID NO: 59117 - protein, 81 aa, Balaenoptera acutorostrata scammoni; identical to SEQ ID NO: 25098

SEQ ID NO: 59118 - protein, 81 aa, Rhinolophus ferrumequinum; identical to SEQ ID NO: 25139

SEQ ID NO: 59119 - protein, 81 aa, Ursus arctos horribilis; identical to SEQ ID NO: 25147

SEQ ID NO: 59120 - protein, 81 aa, Propithecus coquereli; identical to SEQ ID NO: 25154

SEQ ID NO: 59121 - protein, 81 aa, Propithecus coquereli; identical to SEQ ID NO: 25161

SEQ ID NO: 59122 - protein, 81 aa, Myotis brandtii; identical to SEQ ID NO: 25202

SEQ ID NO: 59123 - protein, 81 aa, Propithecus coquereli; identical to SEQ ID NO: 25232

SEQ ID NO: 59124 - protein, 81 aa, Vombatus ursinus; identical to SEQ ID NO: 25271

SEQ ID NO: 59125 - protein, 81 aa, Propithecus coquereli; identical to SEQ ID NO: 25323

SEQ ID NO: 59126 - protein, 81 aa, Pteropus alecto; identical to SEQ ID NO: 25331

SEQ ID NO: 59127 - protein, 81 aa, Muntiacus reevesi; identical to SEQ ID NO: 25349

SEQ ID NO: 59128 - protein, 81 aa, Ursus arctos horribilis; identical to SEQ ID NO: 25375

SEQ ID NO: 59129 - protein, 81 aa, Muntiacus reevesi; identical to SEQ ID NO: 25401

SEQ ID NO: 59130 - protein, 81 aa, Propithecus coquereli; identical to SEQ ID NO: 25425

SEQ ID NO: 59131 - protein, 81 aa, Myotis brandtii; identical to SEQ ID NO: 25436

SEQ ID NO: 59132 - protein, 81 aa, Macaca nemestrina; identical to SEQ ID NO: 25498

SEQ ID NO: 59133 - protein, 81 aa, Propithecus coquereli; identical to SEQ ID NO: 25512

SEQ ID NO: 59134 - protein, 81 aa, Propithecus coquereli; identical to SEQ ID NO: 25565

SEQ ID NO: 59135 - protein, 81 aa, Balaenoptera acutorostrata scammoni; identical to SEQ ID NO: 25582

SEQ ID NO: 59136 - protein, 81 aa, Ursus americanus; identical to SEQ ID NO: 25615

SEQ ID NO: 59137 - protein, 81 aa, Balaenoptera acutorostrata scammoni; identical to SEQ ID NO: 25634

SEQ ID NO: 59138 - protein, 81 aa, Balaenoptera acutorostrata scammoni; identical to SEQ ID NO: 25637

SEQ ID NO: 59139 - protein, 81 aa, Ursus americanus; identical to SEQ ID NO: 25665

SEQ ID NO: 59140 - protein, 81 aa, Saimiri boliviensis boliviensis; identical to SEQ ID NO: 25689

SEQ ID NO: 59141 - protein, 81 aa, Balaenoptera acutorostrata scammoni; identical to SEQ ID NO: 25690

SEQ ID NO: 59142 - protein, 81 aa, Ursus americanus; identical to SEQ ID NO: 25719

SEQ ID NO: 59143 - protein, 81 aa, Cervus elaphus hippelaphus; identical to SEQ ID NO: 25733

SEQ ID NO: 59144 - protein, 81 aa, Colobus angolensis palliatus; identical to SEQ ID NO: 25734

SEQ ID NO: 59145 - protein, 81 aa, Cervus elaphus hippelaphus; identical to SEQ ID NO: 25772

SEQ ID NO: 59146 - protein, 81 aa, Lynx pardinus; identical to SEQ ID NO: 25796

SEQ ID NO: 59147 - protein, 81 aa, Muntiacus reevesi; identical to SEQ ID NO: 25838

SEQ ID NO: 59148 - protein, 81 aa, Ursus arctos horribilis; identical to SEQ ID NO: 25844

SEQ ID NO: 59149 - protein, 81 aa, Myotis brandtii; identical to SEQ ID NO: 25890

SEQ ID NO: 59150 - protein, 81 aa, Vombatus ursinus; identical to SEQ ID NO: 25905

SEQ ID NO: 59151 - protein, 81 aa, Vombatus ursinus; identical to SEQ ID NO: 25907

SEQ ID NO: 59152 - protein, 81 aa, Pteropus alecto; identical to SEQ ID NO: 25957

SEQ ID NO: 59153 - protein, 81 aa, Nomascus leucogenys; identical to SEQ ID NO: 25986

SEQ ID NO: 59154 - protein, 81 aa, Ailuropoda melanoleuca; identical to SEQ ID NO: 26022

SEQ ID NO: 59155 - protein, 81 aa, Phascolarctos cinereus; identical to SEQ ID NO: 26058

SEQ ID NO: 59156 - protein, 81 aa, Ursus maritimus; identical to SEQ ID NO: 26066

SEQ ID NO: 59157 - protein, 81 aa, Muntiacus muntjak; identical to SEQ ID NO: 26094

SEQ ID NO: 59158 - protein, 81 aa, Oryctolagus cuniculus; identical to SEQ ID NO: 26112

SEQ ID NO: 59159 - protein, 81 aa, Oryctolagus cuniculus; identical to SEQ ID NO: 26135

SEQ ID NO: 59160 - protein, 81 aa, Pteropus alecto; identical to SEQ ID NO: 26171

SEQ ID NO: 59161 - protein, 81 aa, Ailuropoda melanoleuca; identical to SEQ ID NO: 26179

SEQ ID NO: 59162 - protein, 81 aa, Phascolarctos cinereus; identical to SEQ ID NO: 26182

SEQ ID NO: 59163 - protein, 81 aa, Sapajus apella; identical to SEQ ID NO: 26189

SEQ ID NO: 59164 - protein, 81 aa, Phascolarctos cinereus; identical to SEQ ID NO: 26210

SEQ ID NO: 59165 - protein, 81 aa, Phascolarctos cinereus; identical to SEQ ID NO: 26213

SEQ ID NO: 59166 - protein, 81 aa, Canis lupus familiaris; identical to SEQ ID NO: 26225

SEQ ID NO: 59167 - protein, 81 aa, Puma concolor; identical to SEQ ID NO: 26245

SEQ ID NO: 59168 - protein, 81 aa, Sapajus apella; identical to SEQ ID NO: 26247

SEQ ID NO: 59169 - protein, 81 aa, Sapajus apella; identical to SEQ ID NO: 26250

SEQ ID NO: 59170 - protein, 81 aa, Macaca nemestrina; identical to SEQ ID NO: 26265

SEQ ID NO: 59171 - protein, 81 aa, Muntiacus reevesi; identical to SEQ ID NO: 26269

SEQ ID NO: 59172 - protein, 81 aa, Myotis brandtii; identical to SEQ ID NO: 26276

SEQ ID NO: 59173 - protein, 81 aa, Macaca nemestrina; identical to SEQ ID NO: 26313

SEQ ID NO: 59174 - protein, 81 aa, Panthera pardus; identical to SEQ ID NO: 26323

SEQ ID NO: 59175 - protein, 81 aa, Saimiri boliviensis boliviensis; identical to SEQ ID NO: 26353

SEQ ID NO: 59176 - protein, 81 aa, Oryctolagus cuniculus; identical to SEQ ID NO: 26354

SEQ ID NO: 59177 - protein, 81 aa, Phascolarctos cinereus; identical to SEQ ID NO: 26453

SEQ ID NO: 59178 - protein, 81 aa, Rhinolophus ferrumequinum; identical to SEQ ID NO: 26503

SEQ ID NO: 59179 - protein, 81 aa, Ursus maritimus; identical to SEQ ID NO: 26508

SEQ ID NO: 59180 - protein, 81 aa, Lynx canadensis; identical to SEQ ID NO: 26519

SEQ ID NO: 59181 - protein, 81 aa, Puma concolor; identical to SEQ ID NO: 26529

SEQ ID NO: 59182 - protein, 81 aa, Muntiacus reevesi; identical to SEQ ID NO: 26562

SEQ ID NO: 59183 - protein, 80 aa, Ursus maritimus; identical to SEQ ID NO: 26653

SEQ ID NO: 59184 - protein, 81 aa, Panthera pardus; identical to SEQ ID NO: 26673

SEQ ID NO: 59185 - protein, 81 aa, Muntiacus reevesi; identical to SEQ ID NO: 26683

SEQ ID NO: 59186 - protein, 81 aa, Muntiacus reevesi; identical to SEQ ID NO: 26684

SEQ ID NO: 59187 - protein, 81 aa, Ursus maritimus; identical to SEQ ID NO: 26742

SEQ ID NO: 59188 - protein, 81 aa, Rhinopithecus bieti; identical to SEQ ID NO: 26747

SEQ ID NO: 59189 - protein, 81 aa, Ursus arctos horribilis; identical to SEQ ID NO: 26768

SEQ ID NO: 59190 - protein, 81 aa, Pteropus alecto; identical to SEQ ID NO: 26773

SEQ ID NO: 59191 - protein, 81 aa, Muntiacus reevesi; identical to SEQ ID NO: 26790

SEQ ID NO: 59192 - protein, 81 aa, Rhinopithecus bieti; identical to SEQ ID NO: 26801

SEQ ID NO: 59193 - protein, 81 aa, Panthera pardus; identical to SEQ ID NO: 26805

SEQ ID NO: 59194 - protein, 81 aa, Pteropus alecto; identical to SEQ ID NO: 26845

SEQ ID NO: 59195 - protein, 81 aa, Sapajus apella; identical to SEQ ID NO: 26860

SEQ ID NO: 59196 - protein, 81 aa, Rhinopithecus bieti; identical to SEQ ID NO: 26899

SEQ ID NO: 59197 - protein, 81 aa, Puma concolor; identical to SEQ ID NO: 26926

SEQ ID NO: 59198 - protein, 81 aa, Rhinolophus ferrumequinum; identical to SEQ ID NO: 26961

SEQ ID NO: 59199 - protein, 81 aa, Ursus maritimus; identical to SEQ ID NO: 26963

SEQ ID NO: 59200 - protein, 81 aa, Balaenoptera acutorostrata scammoni; identical to SEQ ID NO: 26976

SEQ ID NO: 59201 - protein, 81 aa, Vombatus ursinus; identical to SEQ ID NO: 26984

SEQ ID NO: 59202 - protein, 81 aa, Vombatus ursinus; identical to SEQ ID NO: 26988

SEQ ID NO: 59203 - protein, 81 aa, Geotrypetes seraphini; identical to SEQ ID NO: 27091

SEQ ID NO: 59204 - protein, 81 aa, Geotrypetes seraphini; identical to SEQ ID NO: 27092

SEQ ID NO: 59205 - protein, 81 aa, Geotrypetes seraphini; identical to SEQ ID NO: 27115

SEQ ID NO: 59206 - protein, 81 aa, Geotrypetes seraphini; identical to SEQ ID NO: 27129

SEQ ID NO: 59207 - protein, 81 aa, Geotrypetes seraphini; identical to SEQ ID NO: 27131

SEQ ID NO: 59208 - protein, 81 aa, Geotrypetes seraphini; identical to SEQ ID NO: 27163

SEQ ID NO: 59209 - protein, 81 aa, Geotrypetes seraphini; identical to SEQ ID NO: 27222

SEQ ID NO: 59210 - protein, 81 aa, Geotrypetes seraphini; identical to SEQ ID NO: 27246

SEQ ID NO: 59211 - protein, 81 aa, Geotrypetes seraphini; identical to SEQ ID NO: 27250

SEQ ID NO: 59212 - protein, 81 aa, Geotrypetes seraphini; identical to SEQ ID NO: 27253

SEQ ID NO: 59213 - protein, 81 aa, Geotrypetes seraphini; identical to SEQ ID NO: 27282

SEQ ID NO: 59214 - protein, 81 aa, Geotrypetes seraphini; identical to SEQ ID NO: 27296

SEQ ID NO: 59215 - protein, 81 aa, Geotrypetes seraphini; identical to SEQ ID NO: 27299

SEQ ID NO: 59216 - protein, 81 aa, Geotrypetes seraphini; identical to SEQ ID NO: 27313

SEQ ID NO: 59217 - protein, 81 aa, Pelodiscus sinensis; identical to SEQ ID NO: 27330

SEQ ID NO: 59218 - protein, 81 aa, Colinus virginianus; identical to SEQ ID NO: 27352

SEQ ID NO: 59219 - protein, 81 aa, Pelodiscus sinensis; identical to SEQ ID NO: 27355

SEQ ID NO: 59220 - protein, 81 aa, Geotrypetes seraphini; identical to SEQ ID NO: 27384

SEQ ID NO: 59221 - protein, 81 aa, Geotrypetes seraphini; identical to SEQ ID NO: 27387

SEQ ID NO: 59222 - protein, 81 aa, Geotrypetes seraphini; identical to SEQ ID NO: 27411

SEQ ID NO: 59223 - protein, 81 aa, Geotrypetes seraphini; identical to SEQ ID NO: 27418

SEQ ID NO: 59224 - protein, 81 aa, Geotrypetes seraphini; identical to SEQ ID NO: 27424

SEQ ID NO: 59225 - protein, 81 aa, Geotrypetes seraphini; identical to SEQ ID NO: 27425

SEQ ID NO: 59226 - protein, 81 aa, Colinus virginianus; identical to SEQ ID NO: 27454

SEQ ID NO: 59227 - protein, 81 aa, Pelodiscus sinensis; identical to SEQ ID NO: 27459

SEQ ID NO: 59228 - protein, 81 aa, Pelodiscus sinensis; identical to SEQ ID NO: 27472

SEQ ID NO: 59229 - protein, 81 aa, Pseudonaja textilis; identical to SEQ ID NO: 27492

SEQ ID NO: 59230 - protein, 81 aa, Colinus virginianus; identical to SEQ ID NO: 27526

SEQ ID NO: 59231 - protein, 81 aa, Pelodiscus sinensis; identical to SEQ ID NO: 27533

SEQ ID NO: 59232 - protein, 81 aa, Pelodiscus sinensis; identical to SEQ ID NO: 27534

SEQ ID NO: 59233 - protein, 81 aa, Pelodiscus sinensis; identical to SEQ ID NO: 27535

SEQ ID NO: 59234 - protein, 81 aa, Pelodiscus sinensis; identical to SEQ ID NO: 27536

SEQ ID NO: 59235 - protein, 81 aa, Pelodiscus sinensis; identical to SEQ ID NO: 27542

SEQ ID NO: 59236 - protein, 81 aa, Pelodiscus sinensis; identical to SEQ ID NO: 27549

SEQ ID NO: 59237 - protein, 81 aa, Pelodiscus sinensis; identical to SEQ ID NO: 27558

SEQ ID NO: 59238 - protein, 81 aa, Pelodiscus sinensis; identical to SEQ ID NO: 27582

SEQ ID NO: 59239 - protein, 81 aa, Pelodiscus sinensis; identical to SEQ ID NO: 27588

SEQ ID NO: 59240 - protein, 81 aa, Geotrypetes seraphini; identical to SEQ ID NO: 27615

SEQ ID NO: 59241 - protein, 81 aa, Geotrypetes seraphini; identical to SEQ ID NO: 27620

SEQ ID NO: 59242 - protein, 81 aa, Geotrypetes seraphini; identical to SEQ ID NO: 27637

SEQ ID NO: 59243 - protein, 81 aa, Geotrypetes seraphini; identical to SEQ ID NO: 27696

SEQ ID NO: 59244 - protein, 81 aa, Gopherus agassizii; identical to SEQ ID NO: 27753

SEQ ID NO: 59245 - protein, 81 aa, Gopherus agassizii; identical to SEQ ID NO: 27755

SEQ ID NO: 59246 - protein, 81 aa, Phasianus colchicus; identical to SEQ ID NO: 27779

SEQ ID NO: 59247 - protein, 81 aa, Paroedura picta; identical to SEQ ID NO: 27798

SEQ ID NO: 59248 - protein, 81 aa, Meleagris gallopavo; identical to SEQ ID NO: 27899

SEQ ID NO: 59249 - protein, 81 aa, Meleagris gallopavo; identical to SEQ ID NO: 27902

SEQ ID NO: 59250 - protein, 81 aa, Meleagris gallopavo; identical to SEQ ID NO: 27914

SEQ ID NO: 59251 - protein, 81 aa, Meleagris gallopavo; identical to SEQ ID NO: 27919

SEQ ID NO: 59252 - protein, 81 aa, Aquila chrysaetos chrysaetos; identical to SEQ ID NO: 27922

SEQ ID NO: 59253 - protein, 81 aa, Mus musculus; identical to SEQ ID NO: 27971

SEQ ID NO: 59254 - protein, 81 aa, Mus musculus; identical to SEQ ID NO: 27972

SEQ ID NO: 59255 - protein, 81 aa, Homo sapiens; identical to SEQ ID NO: 878

SEQ ID NO: 59256 - protein, 81 aa, Alligator sinensis; identical to SEQ ID NO: 28044

SEQ ID NO: 59257 - protein, 81 aa, Xenopus laevis; identical to SEQ ID NO: 28118

SEQ ID NO: 59258 - protein, 81 aa, Alligator mississippiensis; identical to SEQ ID NO: 28151

SEQ ID NO: 59259 - protein, 81 aa, Peromyscus maniculatus bairdii; identical to SEQ ID NO: 28404

SEQ ID NO: 59260 - protein, 81 aa, Sus scrofa; identical to SEQ ID NO: 28617

SEQ ID NO: 59261 - protein, 81 aa, Suricata suricatta; identical to SEQ ID NO: 28640

SEQ ID NO: 59262 - protein, 81 aa, Muntiacus muntjak; identical to SEQ ID NO: 28682

SEQ ID NO: 59263 - protein, 81 aa, Muntiacus muntjak; identical to SEQ ID NO: 28685

SEQ ID NO: 59264 - protein, 81 aa, Muntiacus muntjak; identical to SEQ ID NO: 28698

SEQ ID NO: 59265 - protein, 81 aa, Canis lupus familiaris; identical to SEQ ID NO: 28700

SEQ ID NO: 59266 - protein, 81 aa, Macaca fascicularis; identical to SEQ ID NO: 28758

SEQ ID NO: 59267 - protein, 81 aa, Puma concolor; identical to SEQ ID NO: 28761

SEQ ID NO: 59268 - protein, 81 aa, Myotis lucifugus; identical to SEQ ID NO: 28809

SEQ ID NO: 59269 - protein, 81 aa, Phascolarctos cinereus; identical to SEQ ID NO: 28824

SEQ ID NO: 59270 - protein, 81 aa, Bos taurus; identical to SEQ ID NO: 28878

SEQ ID NO: 59271 - protein, 81 aa, Callithrix jacchus; identical to SEQ ID NO: 28886

SEQ ID NO: 59272 - protein, 81 aa, Odocoileus virginianus texanus; identical to SEQ ID NO: 28896

SEQ ID NO: 59273 - protein, 81 aa, Ovis aries; identical to SEQ ID NO: 28903

SEQ ID NO: 59274 - protein, 81 aa, Cebus imitator; identical to SEQ ID NO: 28928

SEQ ID NO: 59275 - protein, 81 aa, Vulpes vulpes; identical to SEQ ID NO: 28946

SEQ ID NO: 59276 - protein, 81 aa, Callithrix jacchus; identical to SEQ ID NO: 28952

SEQ ID NO: 59277 - protein, 81 aa, Pongo abelii; identical to SEQ ID NO: 28985

SEQ ID NO: 59278 - protein, 81 aa, Bison bison bison; identical to SEQ ID NO: 29005

SEQ ID NO: 59279 - protein, 81 aa, Vulpes vulpes; identical to SEQ ID NO: 29021

SEQ ID NO: 59280 - protein, 81 aa, Camelus dromedarius; identical to SEQ ID NO: 29107

SEQ ID NO: 59281 - protein, 81 aa, Neomonachus schauinslandi; identical to SEQ ID NO: 29170

SEQ ID NO: 59282 - protein, 81 aa, Enhydra lutris kenyoni; identical to SEQ ID NO: 29190

SEQ ID NO: 59283 - protein, 81 aa, Enhydra lutris kenyoni; identical to SEQ ID NO: 29204

SEQ ID NO: 59284 - protein, 81 aa, Physeter macrocephalus; identical to SEQ ID NO: 29222

SEQ ID NO: 59285 - protein, 81 aa, Aotus trivirgatus; identical to SEQ ID NO: 29237

SEQ ID NO: 59286 - protein, 81 aa, Odocoileus virginianus texanus; identical to SEQ ID NO: 29277

SEQ ID NO: 59287 - protein, 81 aa, Callithrix jacchus; identical to SEQ ID NO: 29283

SEQ ID NO: 59288 - protein, 81 aa, Capra hircus; identical to SEQ ID NO: 29418

SEQ ID NO: 59289 - protein, 81 aa, Pteropus vampyrus; identical to SEQ ID NO: 29428

SEQ ID NO: 59290 - protein, 81 aa, Pan paniscus; identical to SEQ ID NO: 29454

SEQ ID NO: 59291 - protein, 81 aa, Homo sapiens; identical to SEQ ID NO: 887

SEQ ID NO: 59292 - protein, 81 aa, Gulo gulo; identical to SEQ ID NO: 29536

SEQ ID NO: 59293 - protein, 81 aa, Erinaceus europaeus; identical to SEQ ID NO: 29540

SEQ ID NO: 59294 - protein, 81 aa, Muntiacus reevesi; identical to SEQ ID NO: 29626

SEQ ID NO: 59295 - protein, 81 aa, Propithecus coquereli; identical to SEQ ID NO: 29632

SEQ ID NO: 59296 - protein, 81 aa, Propithecus coquereli; identical to SEQ ID NO: 29652

SEQ ID NO: 59297 - protein, 81 aa, Rhinolophus ferrumequinum; identical to SEQ ID NO: 29707

SEQ ID NO: 59298 - protein, 81 aa, Rhinolophus ferrumequinum; identical to SEQ ID NO: 29738

SEQ ID NO: 59299 - protein, 81 aa, Microcaecilia unicolor; identical to SEQ ID NO: 29942

SEQ ID NO: 59300 - protein, 81 aa, Camelus ferus; identical to SEQ ID NO: 29964

SEQ ID NO: 59301 - protein, 84 aa, Mus musculus; identical to SEQ ID NO: 30048

SEQ ID NO: 59302 - protein, 92 aa, Xenopus tropicalis; identical to SEQ ID NO: 30185

SEQ ID NO: 59303 - protein, 93 aa, Chelonia mydas; identical to SEQ ID NO: 30283

SEQ ID NO: 59304 - protein, 84 aa, Peromyscus maniculatus bairdii; identical to SEQ ID NO: 30379

SEQ ID NO: 59305 - protein, 83 aa, Mesocricetus auratus; identical to SEQ ID NO: 30458

SEQ ID NO: 59306 - protein, 84 aa, Mesocricetus auratus; identical to SEQ ID NO: 30496

SEQ ID NO: 59307 - protein, 84 aa, Mus caroli; identical to SEQ ID NO: 30545

SEQ ID NO: 59308 - protein, 83 aa, Mus caroli; identical to SEQ ID NO: 30553

SEQ ID NO: 59309 - protein, 93 aa, Mus caroli; identical to SEQ ID NO: 30586

SEQ ID NO: 59310 - protein, 84 aa, Cricetulus griseus; identical to SEQ ID NO: 30590

SEQ ID NO: 59311 - protein, 84 aa, Peromyscus maniculatus bairdii; identical to SEQ ID NO: 30630

SEQ ID NO: 59312 - protein, 84 aa, Peromyscus maniculatus bairdii; identical to SEQ ID NO: 30733

SEQ ID NO: 59313 - protein, 82 aa, Mesocricetus auratus; identical to SEQ ID NO: 30735

SEQ ID NO: 59314 - protein, 92 aa, Erinaceus europaeus; identical to SEQ ID NO: 30884

SEQ ID NO: 59315 - protein, 87 aa, Nomascus leucogenys; identical to SEQ ID NO: 31019

SEQ ID NO: 59316 - protein, 87 aa, Rhinopithecus roxellana; identical to SEQ ID NO: 31304

SEQ ID NO: 59317 - protein, 89 aa, Bison bison bison; identical to SEQ ID NO: 31330

SEQ ID NO: 59318 - protein, 114 aa, Callithrix jacchus; identical to SEQ ID NO: 31355

SEQ ID NO: 59319 - protein, 84 aa, Macaca mulatta; identical to SEQ ID NO: 31448

SEQ ID NO: 59320 - protein, 83 aa, Pan troglodytes; identical to SEQ ID NO: 31902

SEQ ID NO: 59321 - protein, 87 aa, Vicugna pacos; identical to SEQ ID NO: 32354

SEQ ID NO: 59322 - protein, 84 aa, Homo sapiens; identical to SEQ ID NO: 32459

SEQ ID NO: 59323 - protein, 91 aa, Propithecus coquereli; identical to SEQ ID NO: 32502

SEQ ID NO: 59324 - protein, 92 aa, Balaenoptera acutorostrata scammoni; identical to SEQ ID NO: 32757

SEQ ID NO: 59325 - protein, 93 aa, Notechis scutatus; identical to SEQ ID NO: 32917

SEQ ID NO: 59326 - protein, 97 aa, Rhinolophus ferrumequinum; identical to SEQ ID NO: 33054

SEQ ID NO: 59327 - protein, 80 aa, Homo sapiens
AFEDVAVYFSQEEWGLLDTAQRALYRRVMLDNFALVASLGLSTSRPRVVIQLERGEEPWVPSGTDTTLSRTTYRRRNPGS

SEQ ID NO: 59328 - protein, 80 aa, Homo sapiens
RESLEDEVTPGLPTAESQELLTFKDISIDFTQEEWGQLAPAHQNLYREVMLENYSNLVSVGYQLSKPSVISQLEKGEEPW

SEQ ID NO: 59329 - protein, 80 aa, Homo sapiens
ALRSVMFSDVSIDFSPEEWEYLDLEQKDLYRDVMLENYSNLVSLGCFISKPDVISSLEQGKEPWKVVRKGRRQYPDLETK

SEQ ID NO: 59330 - protein, 80 aa, Homo sapiens
DSVAFEDVAVNFTQEEWALLSPSQKNLYRDVTLETFRNLASVGIQWKDQDIENLYQNLGIKLRSLVERLCGRKEGNEHRE

SEQ ID NO: 59331 - protein, 80 aa, Homo sapiens
SQVTFSDVAIDFSHEEWACLDSAQRDLYKDVMVQNYENLVSVGLSVTKPYVIMLLEDGKEPWMMEKKLSKAYPFPLSHSV

SEQ ID NO: 59332 - protein, 80 aa, Homo sapiens
GPQGARRQAFLAFGDVTVDFTQKEWRLLSPAQRALYREVTLENYSHLVSLGILHSKPELIRRLEQGEVPWGEERRRRPGP

SEQ ID NO: 59333 - protein, 80 aa, Homo sapiens
NVEVVKVMPQDLVTFKDVAIDFSQEEWQWMNPAQKRLYRSMMLENYQSLVSLGLCISKPYVISLLEQGREPWEMTSEMTR

SEQ ID NO: 59334 - protein, 80 aa, Homo sapiens
EETQGELTSSCGSKTMANVSLAFRDVSIDLSQEEWECLDAVQRDLYKDVMLENYSNLVSLGYTIPKPDVITLLEQEKEPW

SEQ ID NO: 59335 - protein, 80 aa, Homo sapiens
DTVVFEDVVVDFTLEEWALLNPAQRKLYRDVMLETFKHLASVDNEAQLKASGSISQQDTSGEKLSLKQKIEKFTRKNIWA

SEQ ID NO: 59336 - protein, 80 aa, Homo sapiens
GSLEEGRRATGLPAAQVQEPVTFKDVAVDFTQEEWGQLDLVQRTLYRDVMLETYGHLLSVGNQIAKPEVISLLEQGEEPW

SEQ ID NO: 59337 - protein, 80 aa, Homo sapiens
TQPDEDLHLQAEETQLVKESVTFKDVAIDFTLEEWRLMDPTQRNLHKDVMLENYRNLVSLGLAVSKPDMISHLENGKGPW

SEQ ID NO: 59338 - protein, 80 aa, Homo sapiens
NMSQASVSFQDVTVEFTREEWQHLGPVERTLYRDVMLENYSHLISVGYCITKPKVISKLEKGEEPWSLEDEFLNQRYPGY

SEQ ID NO: 59339 - protein, 80 aa, Homo sapiens
EPLKFRDVAIEFSLEEWQCLDTIQQNLYRNVMLENYRNLVFLGIVVSKPDLITCLEQEKEPWTRKRHRMVAEPPVICSHF

SEQ ID NO: 59340 - protein, 80 aa, Homo sapiens
RVLTFRDVAVEFSPEEWECLDSAQQRLYRDVMLENYGNLFSLGLAIFKPDLITYLEQRKEPWNARRQKTVAKHPAGSLHF

SEQ ID NO: 59341 - protein, 80 aa, Homo sapiens
NMEGLVMFQDLSIDFSQEEWECLDAAQKDLYRDVMMENYSSLVSLGLSIPKPDVISLLEQGKEPWMVSRDVLGGWCRDSE

SEQ ID NO: 59342 - protein, 80 aa, Homo sapiens
QDPSAEGLSEEVPVVFEELPVVFEDVAVYFTREEWGMLDKRQKELYRDVMRMNYELLASLGPAAAKPDLISKLERRAAPW

SEQ ID NO: 59343-59344 - skipped (2 entries)

SEQ ID NO: 59345 - protein, 10 aa, synthetic construct
  VARIANT 2: note = K or R
  VARIANT 3: note = A, D, E, G, N, S, or T
  VARIANT 7: note = D, E, or S
  VARIANT 10: note = L or R
QXXLYRXVMX

SEQ ID NO: 59346 - protein, 15 aa, synthetic construct
  VARIANT 1: note = A, L, P, or S
  VARIANT 2: note = L or V
  VARIANT 3: note = S or T
  VARIANT 5: note = A, E, G, K, or R
  VARIANT 8: note = A or T
  VARIANT 9: note = I or V
  VARIANT 10: note = D, E, N, or Y
  VARIANT 12: note = S or T
  VARIANT 13: note = E, P, Q, R, or W
  VARIANT 14: note = E or N
  VARIANT 15: note = E or Q
XXXFXDVXXXFXXXX

SEQ ID NO: 59347 - skipped

SEQ ID NO: 59348 - protein, 15 aa, synthetic construct
  VARIANT 3: note = K or R
  VARIANT 4: note = D or E
  VARIANT 7: note = L, Q, or R
  VARIANT 9: note = N or T
  VARIANT 10: note = F or Y
  VARIANT 11: note = A, E, G, Q, R, or S
  VARIANT 12: note = H, L, or N
  VARIANT 13: note = L or V
  VARIANT 14: note = A, G, I, L, T, or V
  VARIANT 15: note = A, F, or S
LYXXVMXEXXXXXXX

SEQ ID NO: 59349 - protein, 14 aa, synthetic construct
  VARIANT 2: note = A, E, G, K, or R
  VARIANT 5: note = A, S, or T
  VARIANT 7: note = I or V
  VARIANT 6: note = D, E, N, or Y
  VARIANT 9: note = S or T
  VARIANT 10: note = E, L, P, Q, R, or W
  VARIANT 11: note = D or E
  VARIANT 14: note = A, E, G, Q, or R
FXDVXXXFXXXEWX

SEQ ID NO: 59350-59351 - skipped (2 entries)

SEQ ID NO: 59352 - RNA, 89 nt, synthetic construct
  source 1..89: mol_type = other RNA
actggcgcttctatctgattactctgagcgccatcaccagcgactatgtcgtagtgggtaaagctccctcttcggagggagcatcagag

SEQ ID NO: 59353 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 59354 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRWWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 59355 - protein, 979 aa, synthetic construct; identical to SEQ ID NO: 57733

SEQ ID NO: 59356 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLIKLAQLKPEKDSDEAVTYSLGKFGQRALDFYSIHVTKESTHPVKPLAQIAGNRYASSPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 59357 - protein, 979 aa, synthetic construct; identical to SEQ ID NO: 57735

SEQ ID NO: 59358 - protein, 978 aa, synthetic construct
QEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKKFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLPSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAV

SEQ ID NO: 59359 - protein, 46 aa, synthetic construct
PKKKRKVGGSPKKKRKVSRQEIKRINKIRRRLVKDSNTKKAGKTGP

SEQ ID NO: 59360 - protein, 66 aa, synthetic construct
PKKKRKVGGSPKKKRKVGGSPKKKRKVGGSPKKKRKVSRQEIKRINKIRRRLVKDSNTKKAGKTGP

SEQ ID NO: 59361 - protein, 86 aa, synthetic construct
PKKKRKVGGSPKKKRKVGGSPKKKRKVGGSPKKKRKVGGSPKKKRKVGGSPKKKRKVSRQEIKRINKIRRRLVKDSNTKKAGKTGP

SEQ ID NO: 59362 - protein, 50 aa, synthetic construct
PAAKRVKLDGGSPAAKRVKLDSRQEIKRINKIRRRLVKDSNTKKAGKTGP

SEQ ID NO: 59363 - protein, 74 aa, synthetic construct
PAAKRVKLDGGSPAAKRVKLDGGSPAAKRVKLDGGSPAAKRVKLDSRQEIKRINKIRRRLVKDSNTKKAGKTGP

SEQ ID NO: 59364 - protein, 98 aa, synthetic construct
PAAKRVKLDGGSPAAKRVKLDGGSPAAKRVKLDGGSPAAKRVKLDGGSPAAKRVKLDGGSPAAKRVKLDSRQEIKRINKIRRRLVKDSNTKKAGKTGP

SEQ ID NO: 59365 - protein, 49 aa, synthetic construct
KRPAATKKAGQAKKKKSRDISRQEIKRINKIRRRLVKDSNTKKAGKTGP

SEQ ID NO: 59366 - protein, 45 aa, synthetic construct
KRPAATKKAGQAKKKKSRQEIKRINKIRRRLVKDSNTKKAGKTGP

SEQ ID NO: 59367 - protein, 68 aa, synthetic construct
KRPAATKKAGQAKKKKGGSKRPAATKKAGQAKKKKSRDISRQEIKRINKIRRRLVKDSNTKKAGKTGP

SEQ ID NO: 59368 - protein, 106 aa, synthetic construct
KRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 59369 - protein, 144 aa, synthetic construct
KRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKSRDISRQEIKRINKIRRRLVKDSNTKKAGKTGP

SEQ ID NO: 59370 - protein, 70 aa, synthetic construct
PKKKRKVGGSPKKKRKVGGSPKKKRKVGGSPKKKRKVSRDISRQEIKRINKIRRRLVKDSNTKKAGKTGP

SEQ ID NO: 59371 - protein, 78 aa, synthetic construct
PAAKRVKLDGGSPAAKRVKLDGGSPAAKRVKLDGGSPAAKRVKLDSRDISRQEIKRINKIRRRLVKDSNTKKAGKTGP

SEQ ID NO: 59372 - protein, 102 aa, synthetic construct
PAAKRVKLDGGSPAAKRVKLDGGSPAAKRVKLDGGSPAAKRVKLDGGSPAAKRVKLDGGSPAAKRVKLDSRDISRQEIKRINKIRRRLVKDSNTKKAGKTGP

SEQ ID NO: 59373 - protein, 65 aa, synthetic construct
PAAKRVKLDGGKRTADGSEFESPKKKRKVGGSSRDISRQEIKRINKIRRRLVKDSNTKKAGKTGP

SEQ ID NO: 59374 - protein, 67 aa, synthetic construct
PAAKRVKLDGGKRTADGSEFESPKKKRKVPPPPGSRDISRQEIKRINKIRRRLVKDSNTKKAGKTGP

SEQ ID NO: 59375 - protein, 72 aa, synthetic construct
PAAKRVKLDGGKRTADGSEFESPKKKRKVGIHGVPAAPGSRDISRQEIKRINKIRRRLVKDSNTKKAGKTGP

SEQ ID NO: 59376 - protein, 72 aa, synthetic construct
PAAKRVKLDGGKRTADGSEFESPKKKRKVGGGSGGGSPGSRDISRQEIKRINKIRRRLVKDSNTKKAGKTGP

SEQ ID NO: 59377 - protein, 73 aa, synthetic construct
PAAKRVKLDGGKRTADGSEFESPKKKRKVPGGGSGGGSPGSRDISRQEIKRINKIRRRLVKDSNTKKAGKTGP

SEQ ID NO: 59378 - protein, 81 aa, synthetic construct
PAAKRVKLDGGKRTADGSEFESPKKKRKVAEAAAKEAAAKEAAAKAPGSRDISRQEIKRINKIRRRLVKDSNTKKAGKTGP

SEQ ID NO: 59379 - protein, 64 aa, synthetic construct
PAAKRVKLDGGKRTADGSEFESPKKKRKVPGSRDISRQEIKRINKIRRRLVKDSNTKKAGKTGP

SEQ ID NO: 59380 - protein, 55 aa, synthetic construct
PAAKRVKLDGGSPKKKRKVGGSSRDISRQEIKRINKIRRRLVKDSNTKKAGKTGP

SEQ ID NO: 59381 - protein, 54 aa, synthetic construct
PAAKRVKLDPPPPKKKRKVPGSRDISRQEIKRINKIRRRLVKDSNTKKAGKTGP

SEQ ID NO: 59382 - protein, 45 aa, synthetic construct
PAAKRVKLDPGRSRDISRQEIKRINKIRRRLVKDSNTKKAGKTGP

SEQ ID NO: 59383 - protein, 40 aa, synthetic construct
PKKKRKVSRDISRQEIKRINKIRRRLVKDSNTKKAGKTGP

SEQ ID NO: 59384 - protein, 36 aa, synthetic construct
PKKKRKVSRQEIKRINKIRRRLVKDSNTKKAGKTGP

SEQ ID NO: 59385 - protein, 38 aa, synthetic construct
PAAKRVKLDSRQEIKRINKIRRRLVKDSNTKKAGKTGP

SEQ ID NO: 59386 - protein, 21 aa, synthetic construct
TSPKKKRKVALEYPYDVPDYA

SEQ ID NO: 59387 - protein, 33 aa, synthetic construct
TLESKRPAATKKAGQAKKKKAPGEYPYDVPDYA

SEQ ID NO: 59388 - protein, 27 aa, synthetic construct
GSKRPAATKKAGQAKKKKYPYDVPDYA

SEQ ID NO: 59389 - protein, 73 aa, synthetic construct
TLESKRPAATKKAGQAKKKKGGSKRPAATKKAGQAKKKKAPGEYPYDVPDYATSPKKKRKVALEYPYDVPDYA

SEQ ID NO: 59390 - protein, 98 aa, synthetic construct
TLESKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 59391 - protein, 136 aa, synthetic construct
TLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKKTSPKKKRKVALEYPYDVPDYA

SEQ ID NO: 59392 - protein, 74 aa, synthetic construct
TLESPKKKRKVGGSPKKKRKVGGSPKKKRKVGGSPKKKRKVTLESKRPAATKKAGQAKKKKAPGEYPYDVPDYA

SEQ ID NO: 59393 - protein, 12 aa, synthetic construct
APAAKRVKLDSR

SEQ ID NO: 59394 - protein, 11 aa, synthetic construct
MAPKKKRKVSR

SEQ ID NO: 59395 - protein, 9 aa, synthetic construct
GSPKKKRKV

SEQ ID NO: 59396 - protein, 150 aa, synthetic construct
TLESPAAKRVKLDGGSPAAKRVKLDGGSPAAKRVKLDGGSPAAKRVKLDGGSPAAKRVKLDGGSPAAKRVKLDTLESKRPAATKKAGQAKKKKGGSKRPAATKKAGQAKKKKGGSKRPAATKKAGQAKKKKGGSKRPAATKKAGQAKKKK

SEQ ID NO: 59397 - protein, 135 aa, synthetic construct
TLESKRPAATKKAGQAKKKKTLESKRPAATKKAGQAKKKKGGSKRPAATKKAGQAKKKKGGSKRPAATKKAGQAKKKKGGSKRPAATKKAGQAKKKKGGSKRPAATKKAGQAKKKKGGSKRPAATKKAGQAKKKK

SEQ ID NO: 59398 - protein, 80 aa, synthetic construct
TLESKRPAATKKAGQAKKKKGGSKRPAATKKAGQAKKKKTLESPKKKRKVGGSPKKKRKVGGSPKKKRKVGGSPKKKRKV

SEQ ID NO: 59399 - protein, 54 aa, synthetic construct
TLEGGSPKKKRKVTLESPKKKRKVGGSPKKKRKVGGSPKKKRKVGGSPKKKRKV

SEQ ID NO: 59400 - protein, 62 aa, synthetic construct
TLEGGSPKKKRKVTLESPAAKRVKLDGGSPAAKRVKLDGGSPAAKRVKLDGGSPAAKRVKLD

SEQ ID NO: 59401 - protein, 86 aa, synthetic construct
TLEGGSPKKKRKVTLESPAAKRVKLDGGSPAAKRVKLDGGSPAAKRVKLDGGSPAAKRVKLDGGSPAAKRVKLDGGSPAAKRVKLD

SEQ ID NO: 59402 - protein, 33 aa, synthetic construct
TLEGGSPKKKRKVTLESKRPAATKKAGQAKKKK

SEQ ID NO: 59403 - protein, 52 aa, synthetic construct
TLEGGSPKKKRKVTLESKRPAATKKAGQAKKKKGGSKRPAATKKAGQAKKKK

SEQ ID NO: 59404 - protein, 26 aa, synthetic construct
TLEGGSPKKKRKVTLEGGSPKKKRKV

SEQ ID NO: 59405 - protein, 47 aa, synthetic construct
TLEVGPKRTADSQHSTPPKTKRKVEFEPKKKRKVTLEGGSPKKKRKV

SEQ ID NO: 59406 - protein, 53 aa, synthetic construct
TLEVGGGSGGGSKRTADSQHSTPPKTKRKVEFEPKKKRKVTLEGGSPKKKRKV

SEQ ID NO: 59407 - protein, 62 aa, synthetic construct
TLEVAEAAAKEAAAKEAAAKAKRTADSQHSTPPKTKRKVEFEPKKKRKVTLEGGSPKKKRKV

SEQ ID NO: 59408 - protein, 57 aa, synthetic construct
TLEVGPPKKKRKVGGSKRTADSQHSTPPKTKRKVEFEPKKKRKVTLEGGSPKKKRKV

SEQ ID NO: 59409 - protein, 45 aa, synthetic construct
TLEVGPAEAAAKEAAAKEAAAKAPAAKRVKLDTLEGGSPKKKRKV

SEQ ID NO: 59410 - protein, 61 aa, synthetic construct
TLEVGPGGGSGGGSGGGSPAAKRVKLDTLEVGPKRTADSQHSTPPKTKRKVEFEPKKKRKV

SEQ ID NO: 59411 - protein, 65 aa, synthetic construct
TLEVGPPKKKRKVPPPPAAKRVKLDTLEVGGGSGGGSKRTADSQHSTPPKTKRKVEFEPKKKRKV

SEQ ID NO: 59412 - protein, 64 aa, synthetic construct
TLEVGPPAAKRVKLDTLEVAEAAAKEAAAKEAAAKAKRTADSQHSTPPKTKRKVEFEPKKKRKV

SEQ ID NO: 59413 - protein, 78 aa, synthetic construct
TLEVGPKRTADSQHSTPPKTKRKVEFEPKKKRKVTLEVGPPKKKRKVGGSKRTADSQHSTPPKTKRKVEFEPKKKRKV

SEQ ID NO: 59414 - protein, 72 aa, synthetic construct
TLEVGGGSGGGSKRTADSQHSTPPKTKRKVEFEPKKKRKVTLEVGPAEAAAKEAAAKEAAAKAPAAKRVKLD

SEQ ID NO: 59415 - protein, 45 aa, synthetic construct
GSKRPAATKKAGQAKKKKTLEVGPGGGSGGGSGGGSPAAKRVKLD

SEQ ID NO: 59416 - protein, 43 aa, synthetic construct
GSKRPAATKKAGQAKKKKTLEVGPPKKKRKVPPPPAAKRVKLD

SEQ ID NO: 59417 - protein, 33 aa, synthetic construct
GSKRPAATKKAGQAKKKKTLEVGPPAAKRVKLD

SEQ ID NO: 59418 - protein, 43 aa, synthetic construct
GSPKKKRKVTLEVGPKRTADSQHSTPPKTKRKVEFEPKKKRKV

SEQ ID NO: 59419 - protein, 58 aa, synthetic construct
GSKRPAATKKAGQAKKKKTLEVGGGSGGGSKRTADSQHSTPPKTKRKVEFEPKKKRKV

SEQ ID NO: 59420 - protein, 36 aa, synthetic construct
GSKRPAATKKAGQAKKKKGSKRPAATKKAGQAKKKK

SEQ ID NO: 59421 - protein, 18 aa, synthetic construct
GSPKKKRKVGSPKKKRKV

SEQ ID NO: 59422 - protein, 54 aa, synthetic construct
GGGSGGGSKRTADSQHSTPPKTKRKVEFEPKKKRKVGSKRPAATKKAGQAKKKK

SEQ ID NO: 59423 - protein, 58 aa, synthetic construct
GPPKKKRKVGGSKRTADSQHSTPPKTKRKVEFEPKKKRKVGSKRPAATKKAGQAKKKK

SEQ ID NO: 59424 - protein, 44 aa, synthetic construct
TGGGPGGGAAAGSGSPKKKRKVGSGSGSKRPAATKKAGQAKKKK

SEQ ID NO: 59425 - protein, 48 aa, synthetic construct
GPKRTADSQHSTPPKTKRKVEFEPKKKRKVGSKRPAATKKAGQAKKKK

SEQ ID NO: 59426 - protein, 54 aa, synthetic construct
AEAAAKEAAAKEAAAKAKRTADSQHSTPPKTKRKVEFEPKKKRKVGSPKKKRKV

SEQ ID NO: 59427 - protein, 57 aa, synthetic construct
GPPKKKRKVPPPPAAKRVKLDGGGSGGGSKRTADSQHSTPPKTKRKVEFEPKKKRKV

SEQ ID NO: 59428 - protein, 111 aa, synthetic construct
GSPAAKRVKLDGGSPAAKRVKLDGGSPAAKRVKLDGGSPAAKRVKLDGGSPAAKRVKLDGGSPAAKRVKLDGPPKKKRKVGGSKRTADSQHSTPPKTKRKVEFEPKKKRKV

SEQ ID NO: 59429 - protein, 67 aa, synthetic construct
GSPAAKRVKLGGSPAAKRVKLGGSPKKKRKVGGSPKKKRKVTGGGPGGGAAAGSGSPKKKRKVGSGS

SEQ ID NO: 59430 - protein, 67 aa, synthetic construct
GSKRPAATKKAGQAKKKKGGSKRPAATKKAGQAKKKKGPKRTADSQHSTPPKTKRKVEFEPKKKRKV

SEQ ID NO: 59431 - protein, 82 aa, synthetic construct
GSKRPAATKKAGQAKKKKGGSKRPAATKKAGQAKKKKAEAAAKEAAAKEAAAKAKRTADSQHSTPPKTKRKVEFEPKKKRKV

SEQ ID NO: 59432 - protein, 13 aa, synthetic construct
GGGSPAAKRVKLD

SEQ ID NO: 59433 - DNA, 24 bp, synthetic construct
  source 1..24: mol_type = other DNA
gactacaaggatgatgatgataag

SEQ ID NO: 59434 - DNA, 3348 bp, synthetic construct
  source 1..3348: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggta

SEQ ID NO: 59435 - DNA, 3264 bp, synthetic construct
  source 1..3264: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggta

SEQ ID NO: 59436 - DNA, 4197 bp, synthetic construct
  source 1..4197: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggacgcgaaatcacttacggcatggtcgagaacactggttacgttcaaggacgtgtttgtggactttacacgtgaggagtggaaattgctggatactgcgcaacaaattgtgtatcgaaatgtcatgcttgagaattacaagaacctcgtcagtctcggataccagttgacgaaaccggatgtgatccttaggctcgaaaagggggaagaaccttggctggtatcgggaggtggttcgggtggctctggatcaagcccaaagaagaaacggaaggtggaagcctcagtgcaggtgaaaagggtgctggaaaaatcccccggcaaactcctcgtgaagatgcccttccaggcttcccctggcggaaaaggtgaagggggtggcgcaaccacatctgcccaggtcatggtcatcaagcgacctggaaggaaaagaaaggccgaggctgaccctcaggccattccaaagaaacggggacgcaagccagggtccgtggtcgcagctgcagcagctgaggctaagaaaaaggcagtgaaggaaagctccatccgcagtgtgcaggagactgtcctgcccatcaagaagaggaagactagggagaccgtgtccatcgaggtcaaagaagtggtcaagcccctgctcgtgtccaccctgggcgaaaaatctggaaaggggctcaaaacatgcaagtcacctggacggaaaagcaaggagtctagtccaaaggggcgctcaagctccgcttctagtccccctaaaaaggaacaccatcaccatcaccatcacgccgagtctcctaaggctcctatgccactgctcccaccacctccaccacctgagccacagtcaagcgaagaccccatcagcccacccgagcctcaggatctgtcctctagtatttgcaaagaggaaaagatgcccagagcaggcagcctggagagtgatggctgtccaaaagaacccgccaagacccagcctatggtggcagccgctgcaactaccaccacaaccacaactaccacagtggccgaaaaatacaagcatcgcggcgagggcgaacgaaaggacattgtgtcaagctccatgcccagacctaaccgggaggaaccagtcgatagtaggacacccgtgactgagagagtctctagaactagtccaaaaaagaagagaaaggta

SEQ ID NO: 59437 - DNA, 3288 bp, synthetic construct
  source 1..3288: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtaagatgaagaagttccagatccccgtgagcttccaggacctgaccgtgaacttcacccaggaggagtggcagcagctggaccccgcccagagactgctgtacagagatgtgatgctggagaactacagcaacctggtgagcgtgggctaccacgtgagcaagcccgacgtgatcttcaagctggagcagggcgaggagccctggatcgtggaggagttcagcaaccagaactaccccgacactagtccaaaaaagaagagaaaggta

SEQ ID NO: 59438 - protein, 1116 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 59439 - protein, 1088 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 59440 - protein, 1399 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPWLVSGGGSGGSGSSPKKKRKVEASVQVKRVLEKSPGKLLVKMPFQASPGGKGEGGGATTSAQVMVIKRPGRKRKAEADPQAIPKKRGRKPGSVVAAAAAEAKKKAVKESSIRSVQETVLPIKKRKTRETVSIEVKEVVKPLLVSTLGEKSGKGLKTCKSPGRKSKESSPKGRSSSASSPPKKEHHHHHHHAESPKAPMPLLPPPPPPEPQSSEDPISPPEPQDLSSSICKEEKMPRAGSLESDGCPKEPAKTQPMVAAAATTTTTTTTTVAEKYKHRGEGERKDIVSSSMPRPNREEPVDSRTPVTERVSRTSPKKKRKV

SEQ ID NO: 59441 - protein, 1096 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSKMKKFQIPVSFQDLTVNFTQEEWQQLDPAQRLLYRDVMLENYSNLVSVGYHVSKPDVIFKLEQGEEPWIVEEFSNQNYPDTSPKKKRKV

SEQ ID NO: 59442 - protein, 16 aa, synthetic construct
DYKDDDDKDYKDDDDK

SEQ ID NO: 59443 - protein, 220 aa, synthetic construct
GSGATNFSLLKQAGDVEENPGPTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 59444 - DNA, 903 bp, synthetic construct
  source 1..903: mol_type = other DNA
aaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtg

SEQ ID NO: 59445 - DNA, 645 bp, synthetic construct
  source 1..645: mol_type = other DNA
atgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 59446 - DNA, 18 bp, synthetic construct
  source 1..18: mol_type = other DNA
ggcggttccggcggagga

SEQ ID NO: 59447 - DNA, 405 bp, synthetic construct
  source 1..405: mol_type = other DNA
gagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaat

SEQ ID NO: 59448 - DNA, 483 bp, synthetic construct
  source 1..483: mol_type = other DNA
accaaagcagccgacgatgagcctgagtatgaggatggccggggctttggcattggagagctggtgtgggggaaacttcggggcttctcctggtggccaggccgaattgtgtcttggtggatgacaggccggagccgagcagctgaaggcactcgctgggtcatgtggttcggagatggcaagttctcagtggtgtgtgtggagaagctcatgccgctgagctccttctgcagtgcattccaccaggccacctacaacaagcagcccatgtaccgcaaagccatctacgaagtcctccaggtggccagcagccgtgccgggaagctgtttccagcttgccatgacagtgatgaaagtgacagtggcaaggctgtggaagtgcagaacaagcagatgattgaatgggccctcggtggcttccagccctcgggtcctaagggcctggagccaccagaagaagagaagaatccttacaaggaagtt

SEQ ID NO: 59449 - DNA, 123 bp, synthetic construct
  source 1..123: mol_type = other DNA
tacaccgacatgtgggtggagcctgaagcagctgcttacgccccacccccaccagccaagaaacccagaaagagcacaacagagaaacctaaggtcaaggagatcattgatgagcgcacaagg

SEQ ID NO: 59450 - protein, 301 aa, synthetic construct
NHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACV

SEQ ID NO: 59451 - protein, 6 aa, synthetic construct
GGSGGG

SEQ ID NO: 59452 - protein, 135 aa, synthetic construct
ERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFAN

SEQ ID NO: 59453 - protein, 161 aa, synthetic construct
TKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEV

SEQ ID NO: 59454 - protein, 41 aa, synthetic construct
YTDMWVEPEAAAYAPPPPAKKPRKSTTEKPKVKEIIDERTR

SEQ ID NO: 59455 - DNA, 5208 bp, synthetic construct
  source 1..5208: mol_type = other DNA
atggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59456 - DNA, 5613 bp, synthetic construct
  source 1..5613: mol_type = other DNA
atggccccaaagaagaagcggaaggtctctagaatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59457 - DNA, 6219 bp, synthetic construct
  source 1..6219: mol_type = other DNA
atggccccaaagaagaagcggaaggtctctagaatgaccaaagcagccgacgatgagcctgagtatgaggatggccggggctttggcattggagagctggtgtgggggaaacttcggggcttctcctggtggccaggccgaattgtgtcttggtggatgacaggccggagccgagcagctgaaggcactcgctgggtcatgtggttcggagatggcaagttctcagtggtgtgtgtggagaagctcatgccgctgagctccttctgcagtgcattccaccaggccacctacaacaagcagcccatgtaccgcaaagccatctacgaagtcctccaggtggccagcagccgtgccgggaagctgtttccagcttgccatgacagtgatgaaagtgacagtggcaaggctgtggaagtgcagaacaagcagatgattgaatgggccctcggtggcttccagccctcgggtcctaagggcctggagccaccagaagaagagaagaatccttacaaggaagtttacaccgacatgtgggtggagcctgaagcagctgcttacgccccacccccaccagccaagaaacccagaaagagcacaacagagaaacctaaggtcaaggagatcattgatgagcgcacaagggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59458 - DNA, 4710 bp, synthetic construct
  source 1..4710: mol_type = other DNA
atggccccaaagaagaagcggaaggtctctagaatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaattctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59459 - DNA, 5316 bp, synthetic construct
  source 1..5316: mol_type = other DNA
atggccccaaagaagaagcggaaggtctctagaatgaccaaagcagccgacgatgagcctgagtatgaggatggccggggctttggcattggagagctggtgtgggggaaacttcggggcttctcctggtggccaggccgaattgtgtcttggtggatgacaggccggagccgagcagctgaaggcactcgctgggtcatgtggttcggagatggcaagttctcagtggtgtgtgtggagaagctcatgccgctgagctccttctgcagtgcattccaccaggccacctacaacaagcagcccatgtaccgcaaagccatctacgaagtcctccaggtggccagcagccgtgccgggaagctgtttccagcttgccatgacagtgatgaaagtgacagtggcaaggctgtggaagtgcagaacaagcagatgattgaatgggccctcggtggcttccagccctcgggtcctaagggcctggagccaccagaagaagagaagaatccttacaaggaagtttacaccgacatgtgggtggagcctgaagcagctgcttacgccccacccccaccagccaagaaacccagaaagagcacaacagagaaacctaaggtcaaggagatcattgatgagcgcacaagggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaattctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59460 - protein, 1736 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59461 - protein, 1871 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59462 - protein, 2073 aa, synthetic construct
MAPKKKRKVSRMTKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59463 - protein, 1586 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKVDYKDDDDKDYKDDDDK

SEQ ID NO: 59464 - protein, 1772 aa, synthetic construct
MAPKKKRKVSRMTKAADDEPEYEDGRGFGIGELVWGKLRGFSWWPGRIVSWWMTGRSRAAEGTRWVMWFGDGKFSVVCVEKLMPLSSFCSAFHQATYNKQPMYRKAIYEVLQVASSRAGKLFPACHDSDESDSGKAVEVQNKQMIEWALGGFQPSGPKGLEPPEEEKNPYKEVYTDMWVEPEAAAYAPPPPAKKPRKSTTEKPKVKEIIDERTRERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59465 - DNA, 708 bp, synthetic construct
  source 1..708: mol_type = other DNA
gattacaaagatgacgatgacaaagactacaaggatgatgatgataagggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 59466 - protein, 236 aa, synthetic construct
DYKDDDDKDYKDDDDKGSGATNFSLLKQAGDVEENPGPTEYKPTVRLATRDDVPRAVRTLAAAFADYPATRHTVDPDRHIERVTELQELFLTRVGLDIGKVWVADDGAAVAVWTTPESVEAGAVFAEIGPRMAELSGSRLAAQQQMEGLLAPHRPKEPAWFLATVGVSPDHQGKGLGSAVVLPGVEAAERAGVPAFLETSAPRNLPFYERLGFTVTADVEVPEGPRTWCMTRKPGA

SEQ ID NO: 59467 - protein, 1749 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 59468 - protein, 1721 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 59469 - protein, 1756 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKVDYKDDDDKDYKDDDDKGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 59470 - protein, 1728 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKVDYKDDDDKDYKDDDDKGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 59471 - protein, 1740 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 59472 - protein, 1712 aa, synthetic construct
MAPKKKRKVSRGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGPSSGAPPPSGGSPAGSPTSTEEGTSESATPESGPGTSTEPSEGSAPGSPAGSPTSTEEGTSTEPSEGSAPGTSTEPSEMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 59473 - protein, 1738 aa, synthetic construct
MAPKKKRKVSRMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59474 - protein, 1710 aa, synthetic construct
MAPKKKRKVSRMDAKSLTAWSRTLVTFKDVFVDFTREEWKLLDTAQQIVYRNVMLENYKNLVSLGYQLTKPDVILRLEKGEEPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59475 - protein, 1736 aa, synthetic construct; identical to SEQ ID NO: 59460

SEQ ID NO: 59476 - protein, 1708 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDAKSLTAWSRTLVTFKDVFVDFTREEWKLLDTAQQIVYRNVMLENYKNLVSLGYQLTKPDVILRLEKGEEPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59477 - DNA, 5247 bp, synthetic construct
  source 1..5247: mol_type = other DNA
atggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggta

SEQ ID NO: 59478 - DNA, 5163 bp, synthetic construct
  source 1..5163: mol_type = other DNA
atggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggta

SEQ ID NO: 59479 - DNA, 5268 bp, synthetic construct
  source 1..5268: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 59480 - DNA, 5184 bp, synthetic construct
  source 1..5184: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggtagattacaaagatgacgatgacaaagactacaaggatgatgatgataagggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctctt

SEQ ID NO: 59481 - DNA, 5220 bp, synthetic construct
  source 1..5220: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggta

SEQ ID NO: 59482 - DNA, 5136 bp, synthetic construct
  source 1..5136: mol_type = other DNA
atggccccaaagaagaagcggaaggtctctagaggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggta

SEQ ID NO: 59483 - DNA, 5214 bp, synthetic construct
  source 1..5214: mol_type = other DNA
atggccccaaagaagaagcggaaggtctctagaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59484 - DNA, 5130 bp, synthetic construct
  source 1..5130: mol_type = other DNA
atggccccaaagaagaagcggaaggtctctagaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59485 - DNA, 5208 bp, synthetic construct
  source 1..5208: mol_type = other DNA
atggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59486 - DNA, 5124 bp, synthetic construct
  source 1..5124: mol_type = other DNA
atggccccaaagaagaagcggaaggtctctagaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacattgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaatgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtctccaacatgagccgcttggcgaggcagagactgctgggccgatcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagagacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59487 - DNA, 660 bp, synthetic construct
  source 1..660: mol_type = other DNA
ggatccggcgcaacaaacttctctctgctgaaacaagccggagatgtcgaagagaatcctggaccgaccgagtacaagcccacggtgcgcctcgccacccgcgacgacgtccccagggccgtacgcaccctcgccgccgcgttcgccgactaccccgccacgcgccacaccgtcgatccggaccgccacatcgagcgggtcaccgagctgcaagaactcttcctcacgcgcgtcgggctcgacatcggcaaggtgtgggtcgcggacgacggcgccgcggtggcggtctggaccacgccggagagcgtcgaagcgggggcggtgttcgccgagatcggcccgcgcatggccgagttgagcggttcccggctggccgcgcagcaacagatggaaggcctcctggcgccgcaccggcccaaggagcccgcgtggttcctggccaccgtcggagtctcgcccgaccaccagggcaagggtctgggcagcgccgtcgtgctccccggagtggaggcggccgagcgcgccggggtgcccgccttcctggagacctccgcgccccgcaacctccccttctacgagcggctcggcttcaccgtcaccgccgacgtcgaggtgcccgaaggaccgcgcacctggtgcatgacccgcaagcccggtgcc

SEQ ID NO: 59488 - DNA, 5541 bp, synthetic construct
  source 1..5541: mol_type = other DNA
atggccccaaagaagaagcggaaggtctctagaatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggta

SEQ ID NO: 59489 - DNA, 5625 bp, synthetic construct
  source 1..5625: mol_type = other DNA
atggccccaaagaagaagcggaaggtctctagaatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcactagtccaaaaaagaagagaaaggta

SEQ ID NO: 59490 - DNA, 5163 bp, synthetic construct
  source 1..5163: mol_type = other DNA
atggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagggcggttccggcggaggaagcgctcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccactagtccaaaaaagaagagaaaggta

SEQ ID NO: 59491 - DNA, 5247 bp, synthetic construct; identical to SEQ ID NO: 59477
  source 1..5247: mol_type = other DNA

SEQ ID NO: 59492 - DNA, 5535 bp, synthetic construct
  source 1..5535: mol_type = other DNA
atggccccaaagaagaagcggaaggtctctagaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggaggaagcgctatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59493 - DNA, 5619 bp, synthetic construct
  source 1..5619: mol_type = other DNA
atggccccaaagaagaagcggaaggtctctagaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggcggttccggcggaggaagcgctatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59494 - DNA, 5130 bp, synthetic construct
  source 1..5130: mol_type = other DNA
atggccccaaagaagaagcggaaggtctctagaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59495 - DNA, 5214 bp, synthetic construct
  source 1..5214: mol_type = other DNA
atggccccaaagaagaagcggaaggtctctagaatgaacaattcccagggaagagtgaccttcgaggatgtcactgtgaacttcacccagggggagtggcagcggctgaatcccgaacagagaaacttgtacagggatgtgatgctggagaattacagcaaccttgtctctgtgggacaaggggaaaccaccaaacccgatgtgatcttgaggttggaacaaggaaaggagccatggttggaggaagaggaagtgctgggaagtggccgtgcagaaaaaaatggggacattggagggcagatttggaagccaaaggatgtgaaagagagtctcggcggttccggcggaggaagcgctatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59496 - DNA, 5529 bp, synthetic construct
  source 1..5529: mol_type = other DNA
atggccccaaagaagaagcggaaggtctctagaatggagcggctggtgtatgaggtgcgccagaagtgcagaaacatcgaggacatttgtatctcatgtgggagcctcaatgtcaccctggagcacccactcttcattggaggcatgtgccagaactgtaagaactgcttcttggagtgtgcttaccagtatgacgacgatgggtaccagtcctattgcaccatctgctgtggggggcgtgaagtgctcatgtgtgggaacaacaactgctgcaggtgcttttgtgtcgagtgtgtggatctcttggtggggccaggagctgctcaggcagccattaaggaagacccctggaactgctacatgtgcgggcataagggcacctatgggctgctgcgaagacgggaagactggccttctcgactccagatgttctttgccaataaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59497 - DNA, 5151 bp, synthetic construct
  source 1..5151: mol_type = other DNA
atggccccaaagaagaagcggaaggtctctagagttaacggatcaggctctggaggtggaatgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtgtctagcggcaatagtaacgctaacagccgcgggccgagcttcagcagcggcctggtgccgttaagcttgcgcggcagccatatgggccctatggagatatacaagacagtgtctgcatggaagagacagccagtgcgggtactgagcctcttcagaaacatcgacaaggtactaaagagtttgggcttcttggaaagcggttctggttctgggggaggaacgctgaagtacgtggaagatgtcacaaatgtcgtgaggagggacgtggagaaatggggcccctttgacctggtgtacggctcgacgcagcccctaggcagctcttgtgatcgctgtcccggctggtacatgttccagttccaccggatcctgcagtatgcgctgcctcgccaggagagtcagcggcccttcttctggatattcatggacaatctgctgctgactgaggatgaccaagagacaactacccgcttccttcagacagaggctgtgaccctccaggatgtccgtggcagagactaccagaatgctatgcgggtgtggagcaacattccagggctgaagagcaagcatgcgcccctgaccccaaaggaagaagagtatctgcaagcccaagtcagaagcaggagcaagctggacgccccgaaagttgacctcctggtgaagaactgccttctcccgctgagagagtacttcaagtatttttctcaaaactcacttcctcttggcggttccggcggaggaatggatgctaagtcactaactgcctggtcccggacactggtgaccttcaaggatgtatttgtggacttcaccagggaggagtggaagctgctggacactgctcagcagatcgtgtacagaaatgtgatgctggagaactataagaacctggtttccttgggttatcagcttactaagccagatgtgatcctccggttggagaagggagaagagcccggagggccgagctctggcgcacccccaccaagtggagggtctcctgccgggtccccaacatctactgaagaaggcaccagcgaatccgcaacgcccgagtcaggccctggtacctccacagaaccatctgaaggtagtgcgcctggttccccagctggaagccctacttccaccgaagaaggcacgtcaaccgaaccaagtgaaggatctgcccctgggaccagcactgaaccatctgagcaagagatcaagagaatcaacaagatcagaaggagactggtcaaggacagcaacacaaagaaggccggcaagacaggccccatgaaaaccctgctcgtcagagtgatgacccctgacctgagagagcggctggaaaacctgagaaagaagcccgagaacatccctcagcctatcagcaacaccagcagggccaacctgaacaagctgctgaccgactacaccgagatgaagaaagccatcctgcacgtgtactgggaagagttccagaaagaccccgtgggcctgatgagcagagttgctcagcctgccagcaagaagatcgaccagaacaagctgaagcccgagatggacgagaagggcaatctgaccacagccggctttgcctgctctcagtgtggccagcctctgttcgtgtacaagctggaacaggtgtccgagaaaggcaaggcctacaccaactacttcggcagatgtaacgtggccgagcacgagaagctgattctgctggcccagctgaaacctgagaaggactctgatgaggccgtgacctacagcctgggcaagtttggacagagagccctggacttctacagcatccacgtgaccaaagaaagcacacaccccgtgaagcccctggctcagatcgccggcaatagatacgcctctggacctgtgggcaaagccctgtccgatgcctgcatgggaacaatcgccagcttcctgagcaagtaccaggacatcatcatcgagcaccagaaggtggtcaagggcaaccagaagagactggaaagcctgagggagctggccggcaaagagaacctggaataccccagcgtgaccctgcctcctcagcctcacacaaaagaaggcgtggacgcctacaacgaagtgatcgccagagtgagaatgtgggtcaacctgaacctgtggcagaagctgaaactgtccagggacgacgccaagcctctgctgagactgaagggcttccctagcttccctctggtggaaagacaggccaatgaagtggattggtgggacatggtctgcaacgtgaagaagctgatcaacgagaagaaagaggatggcaaggttttctggcagaacctggccggctacaagagacaagaagccctgaggccttacctgagcagcgaagaggaccggaagaagggcaagaagttcgccagataccagctgggcgacctgctgctgcacctggaaaagaagcacggcgaggactggggcaaagtgtacgatgaggcctgggagagaatcgacaagaaggtggaaggcctgagcaagcacattaagctggaagaggaaagaaggagcgaggacgcccaatctaaagccgctctgaccgattggctgagagccaaggccagctttgtgatcgagggcctgaaagaggccgacaaggacgagttctgcagatgcgagctgaagctgcagaagtggtacggcgatctgagaggcaagcccttcgccattgaggccgagaacagcatcctggacatcagcggcttcagcaagcagtacaactgcgccttcatttggcagaaagacggcgtcaagaaactgaacctgtacctgatcatcaattacttcaaaggcggcaagctgcggttcaagaagatcaaacccgaggccttcgaggctaacagattctacaccgtgatcaacaaaaagtccggcgagatcgtgcccatggaagtgaacttcaacttcgacgaccccaacctgattatcctgcctctggccttcggcaagagacagggcagagagttcatctggaacgatctgctgagcctggaaaccggctctctgaagctggccaatggcagagtgatcgagaaaaccctgtacaacaggagaaccagacaggacgagcctgctctgtttgtggccctgaccttcgagagaagagaggtgctggacagcagcaacatcaagcccatgaacctgatcggcgtggcccggggcgagaatatccctgctgtgatcgccctgacagaccctgaaggatgcccactgagcagattcaaggactccctgggcaaccctacacacatcctgagaatcggcgagagctacaaagagaagcagaggacaatccaggccaagaaagaggtggaacagagaagagccggcggatactctaggaagtacgccagcaaggccaagaatctggccgacgacatggtccgaaacaccgccagagatctgctgtactacgccgtgacacaggacgccatgctgatcttcgcgaatctgagcagaggcttcggccggcagggcaagagaacctttatggccgagaggcagtacaccagaatggaagattggctcacagctaaactggcctacgagggactgagcaagacctacctgtccaaaacactggcccagtatacctccaagacctgcagcaattgcggcttcaccatcaccagcgccgactacgacagagtgctggaaaagctcaagaaaaccgccaccggctggatgaccaccatcaacggcaaagagctgaaggttgagggccagatcacctactacaacaggtacaagaggcagaacgtcgtgaaggatctgagcgtggaactggacagactgagcgaagagagcgtgaacaacgacatcagcagctggacaaagggcagatcaggcgaggctctgagcctgctgaagaagaggtttagccacagacctgtgcaagagaagttcgtgtgcctgaactgcggcttcgagacacacgccgctgaacaggctgccctgaacattgccagaagctggctgttcctgagaagccaagagtacaagaagtaccagaccaacaagaccaccggcaacaccgacaagagggcctttgtggaaacctggcagagcttctacagaaaaaagctgaaagaagtctggaagcccgccgtgcgatcgggcggttccggcggaggttccactagtccaaaaaagaagagaaaggta

SEQ ID NO: 59498 - protein, 1847 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMDAKSLTAWSRTLVTFKDVFVDFTREEWKLLDTAQQIVYRNVMLENYKNLVSLGYQLTKPDVILRLEKGEEPTSPKKKRKV

SEQ ID NO: 59499 - protein, 1875 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLTSPKKKRKV

SEQ ID NO: 59500 - protein, 1721 aa, synthetic construct; identical to SEQ ID NO: 59468

SEQ ID NO: 59501 - protein, 1749 aa, synthetic construct; identical to SEQ ID NO: 59467

SEQ ID NO: 59502 - protein, 1845 aa, synthetic construct
MAPKKKRKVSRMDAKSLTAWSRTLVTFKDVFVDFTREEWKLLDTAQQIVYRNVMLENYKNLVSLGYQLTKPDVILRLEKGEEPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59503 - protein, 1873 aa, synthetic construct
MAPKKKRKVSRMNNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59504 - protein, 1710 aa, synthetic construct; identical to SEQ ID NO: 59474

SEQ ID NO: 59505 - protein, 1738 aa, synthetic construct; identical to SEQ ID NO: 59473

SEQ ID NO: 59506 - protein, 1843 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDAKSLTAWSRTLVTFKDVFVDFTREEWKLLDTAQQIVYRNVMLENYKNLVSLGYQLTKPDVILRLEKGEEPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59507 - protein, 1717 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDAKSLTAWSRTLVTFKDVFVDFTREEWKLLDTAQQIVYRNVMLENYKNLVSLGYQLTKPDVILRLEKGEEPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59508 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMAFEDVAVYFSQEEWGLLDTAQRALYRRVMLDNFALVASLGLSTSRPRVVIQLERGEEPWVPSGTDTTLSRTTYRRRNPGSTSPKKKRKV

SEQ ID NO: 59509 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQGSVTFRDVAIDFSQEEWKWLQPAQRDLYRRVMLENYGHLVSLGLSISKPDVVSLLEQGKEPWLGKRNVKRDLFSASESSTSPKKKRKV

SEQ ID NO: 59510 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSVQEPVTFKDVAVDFTQEEWGQLDLVQRTLYRDVMLETYGHLLSVGNQIAKPEVISLLEQGEEPWSVEQACPQHTCPEWMRNTSPKKKRKV

SEQ ID NO: 59511 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSWPESVTFEDVAVYFTQNQWASLDPAQRALYGEVMLENYANVASLVAFPFPKPALISHLERGEAPWGPDPWDTEIPRGISQGTSPKKKRKV

SEQ ID NO: 59512 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQSPLTFGDVAVEFSGEEWAWLDSAQRSLHRSVMLENYRNLASLGLCLSKPEMISSLEQRKEPWAVKRKSTRGMHPDSQTLTSPKKKRKV

SEQ ID NO: 59513 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSFQEAVTFKDVAVVFTEEELGLLDPPQRKLYREVMLENFRNLVSVGHSSSKPDVISQLEREEKLCVKEIHTQRGRHSGGRNQTSPKKKRKV

SEQ ID NO: 59514 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSKEAFVAFGDVAVDFTQEEWRLLSPAQRTLHREVMLETYNHLVSLEIPFSKPKLISQLERGEEPWIEERQRPLGLCPASRPTTSPKKKRKV

SEQ ID NO: 59515 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSQAEVTFEDVAVLFSREEWGRLGPAQRGLYRDVMLETYRNLVSLGAGPAGPKPGVITQLERGDEPWVLDAQGAKGKERLRVSTSPKKKRKV

SEQ ID NO: 59516 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQESVAFEDVAVYFTTKEWAIMVPAERALYRDVMLENYEAVAFVAVPPTSKPALVSHLEQGKESCFIRPPGVLSRSDWRAGTSPKKKRKV

SEQ ID NO: 59517 - protein, 1730 aa, synthetic construct
MAPKKKRKVSRVNGSGSGGGMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSTPVTFEDVVVYFTAAEWVHLTNWQRDFYQAVMMETYELVASVAGDGVPMAEDEEGGVERPVWQYIPRGKRRRKTPQPRADTSPKKKRKV

SEQ ID NO: 59518 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSMAFEDVAVYFSQEEWGLLDTAQRALYRRVMLDNFALVASLGLSTSRPRVVIQLERGEEPWVPSGTDTTLSRTTYRRRNPGSTSPKKKRKV

SEQ ID NO: 59519 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQGSVTFRDVAIDFSQEEWKWLQPAQRDLYRRVMLENYGHLVSLGLSISKPDVVSLLEQGKEPWLGKRNVKRDLFSASESSTSPKKKRKV

SEQ ID NO: 59520 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSVQEPVTFKDVAVDFTQEEWGQLDLVQRTLYRDVMLETYGHLLSVGNQIAKPEVISLLEQGEEPWSVEQACPQHTCPEWMRNTSPKKKRKV

SEQ ID NO: 59521 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSWPESVTFEDVAVYFTQNQWASLDPAQRALYGEVMLENYANVASLVAFPFPKPALISHLERGEAPWGPDPWDTEIPRGISQGTSPKKKRKV

SEQ ID NO: 59522 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQSPLTFGDVAVEFSGEEWAWLDSAQRSLHRSVMLENYRNLASLGLCLSKPEMISSLEQRKEPWAVKRKSTRGMHPDSQTLTSPKKKRKV

SEQ ID NO: 59523 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSFQEAVTFKDVAVVFTEEELGLLDPPQRKLYREVMLENFRNLVSVGHSSSKPDVISQLEREEKLCVKEIHTQRGRHSGGRNQTSPKKKRKV

SEQ ID NO: 59524 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSKEAFVAFGDVAVDFTQEEWRLLSPAQRTLHREVMLETYNHLVSLEIPFSKPKLISQLERGEEPWIEERQRPLGLCPASRPTTSPKKKRKV

SEQ ID NO: 59525 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSQAEVTFEDVAVLFSREEWGRLGPAQRGLYRDVMLETYRNLVSLGAGPAGPKPGVITQLERGDEPWVLDAQGAKGKERLRVSTSPKKKRKV

SEQ ID NO: 59526 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSQESVAFEDVAVYFTTKEWAIMVPAERALYRDVMLENYEAVAFVAVPPTSKPALVSHLEQGKESCFIRPPGVLSRSDWRAGTSPKKKRKV

SEQ ID NO: 59527 - protein, 1856 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEGGSGGGSAQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSSTPVTFEDVVVYFTAAEWVHLTNWQRDFYQAVMMETYELVASVAGDGVPMAEDEEGGVERPVWQYIPRGKRRRKTPQPRADTSPKKKRKV

SEQ ID NO: 59528 - protein, 1719 aa, synthetic construct
MAPKKKRKVSRMAFEDVAVYFSQEEWGLLDTAQRALYRRVMLDNFALVASLGLSTSRPRVVIQLERGEEPWVPSGTDTTLSRTTYRRRNPGSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59529 - protein, 1719 aa, synthetic construct
MAPKKKRKVSRSQGSVTFRDVAIDFSQEEWKWLQPAQRDLYRRVMLENYGHLVSLGLSISKPDVVSLLEQGKEPWLGKRNVKRDLFSASESSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59530 - protein, 1719 aa, synthetic construct
MAPKKKRKVSRVQEPVTFKDVAVDFTQEEWGQLDLVQRTLYRDVMLETYGHLLSVGNQIAKPEVISLLEQGEEPWSVEQACPQHTCPEWMRNGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59531 - protein, 1719 aa, synthetic construct
MAPKKKRKVSRWPESVTFEDVAVYFTQNQWASLDPAQRALYGEVMLENYANVASLVAFPFPKPALISHLERGEAPWGPDPWDTEIPRGISQGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59532 - protein, 1719 aa, synthetic construct
MAPKKKRKVSRSQSPLTFGDVAVEFSGEEWAWLDSAQRSLHRSVMLENYRNLASLGLCLSKPEMISSLEQRKEPWAVKRKSTRGMHPDSQTLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59533 - protein, 1719 aa, synthetic construct
MAPKKKRKVSRFQEAVTFKDVAVVFTEEELGLLDPPQRKLYREVMLENFRNLVSVGHSSSKPDVISQLEREEKLCVKEIHTQRGRHSGGRNQGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59534 - protein, 1719 aa, synthetic construct
MAPKKKRKVSRKEAFVAFGDVAVDFTQEEWRLLSPAQRTLHREVMLETYNHLVSLEIPFSKPKLISQLERGEEPWIEERQRPLGLCPASRPTGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59535 - protein, 1719 aa, synthetic construct
MAPKKKRKVSRQAEVTFEDVAVLFSREEWGRLGPAQRGLYRDVMLETYRNLVSLGAGPAGPKPGVITQLERGDEPWVLDAQGAKGKERLRVSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59536 - protein, 1719 aa, synthetic construct
MAPKKKRKVSRSQESVAFEDVAVYFTTKEWAIMVPAERALYRDVMLENYEAVAFVAVPPTSKPALVSHLEQGKESCFIRPPGVLSRSDWRAGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59537 - protein, 1719 aa, synthetic construct
MAPKKKRKVSRSTPVTFEDVVVYFTAAEWVHLTNWQRDFYQAVMMETYELVASVAGDGVPMAEDEEGGVERPVWQYIPRGKRRRKTPQPRADGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59538 - protein, 1854 aa, synthetic construct
MAPKKKRKVSRMAFEDVAVYFSQEEWGLLDTAQRALYRRVMLDNFALVASLGLSTSRPRVVIQLERGEEPWVPSGTDTTLSRTTYRRRNPGSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59539 - protein, 1854 aa, synthetic construct
MAPKKKRKVSRSQGSVTFRDVAIDFSQEEWKWLQPAQRDLYRRVMLENYGHLVSLGLSISKPDVVSLLEQGKEPWLGKRNVKRDLFSASESSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59540 - protein, 1854 aa, synthetic construct
MAPKKKRKVSRVQEPVTFKDVAVDFTQEEWGQLDLVQRTLYRDVMLETYGHLLSVGNQIAKPEVISLLEQGEEPWSVEQACPQHTCPEWMRNGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59541 - protein, 1854 aa, synthetic construct
MAPKKKRKVSRWPESVTFEDVAVYFTQNQWASLDPAQRALYGEVMLENYANVASLVAFPFPKPALISHLERGEAPWGPDPWDTEIPRGISQGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59542 - protein, 1854 aa, synthetic construct
MAPKKKRKVSRSQSPLTFGDVAVEFSGEEWAWLDSAQRSLHRSVMLENYRNLASLGLCLSKPEMISSLEQRKEPWAVKRKSTRGMHPDSQTLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59543 - protein, 1854 aa, synthetic construct
MAPKKKRKVSRFQEAVTFKDVAVVFTEEELGLLDPPQRKLYREVMLENFRNLVSVGHSSSKPDVISQLEREEKLCVKEIHTQRGRHSGGRNQGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59544 - protein, 1854 aa, synthetic construct
MAPKKKRKVSRKEAFVAFGDVAVDFTQEEWRLLSPAQRTLHREVMLETYNHLVSLEIPFSKPKLISQLERGEEPWIEERQRPLGLCPASRPTGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59545 - protein, 1854 aa, synthetic construct
MAPKKKRKVSRQAEVTFEDVAVLFSREEWGRLGPAQRGLYRDVMLETYRNLVSLGAGPAGPKPGVITQLERGDEPWVLDAQGAKGKERLRVSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59546 - protein, 1854 aa, synthetic construct
MAPKKKRKVSRSQESVAFEDVAVYFTTKEWAIMVPAERALYRDVMLENYEAVAFVAVPPTSKPALVSHLEQGKESCFIRPPGVLSRSDWRAGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59547 - protein, 1854 aa, synthetic construct
MAPKKKRKVSRSTPVTFEDVVVYFTAAEWVHLTNWQRDFYQAVMMETYELVASVAGDGVPMAEDEEGGVERPVWQYIPRGKRRRKTPQPRADGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59548 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAFEDVAVYFSQEEWGLLDTAQRALYRRVMLDNFALVASLGLSTSRPRVVIQLERGEEPWVPSGTDTTLSRTTYRRRNPGSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59549 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGSVTFRDVAIDFSQEEWKWLQPAQRDLYRRVMLENYGHLVSLGLSISKPDVVSLLEQGKEPWLGKRNVKRDLFSASESSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59550 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQEPVTFKDVAVDFTQEEWGQLDLVQRTLYRDVMLETYGHLLSVGNQIAKPEVISLLEQGEEPWSVEQACPQHTCPEWMRNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59551 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGWPESVTFEDVAVYFTQNQWASLDPAQRALYGEVMLENYANVASLVAFPFPKPALISHLERGEAPWGPDPWDTEIPRGISQGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59552 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQSPLTFGDVAVEFSGEEWAWLDSAQRSLHRSVMLENYRNLASLGLCLSKPEMISSLEQRKEPWAVKRKSTRGMHPDSQTLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59553 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQEAVTFKDVAVVFTEEELGLLDPPQRKLYREVMLENFRNLVSVGHSSSKPDVISQLEREEKLCVKEIHTQRGRHSGGRNQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59554 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKEAFVAFGDVAVDFTQEEWRLLSPAQRTLHREVMLETYNHLVSLEIPFSKPKLISQLERGEEPWIEERQRPLGLCPASRPTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59555 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQAEVTFEDVAVLFSREEWGRLGPAQRGLYRDVMLETYRNLVSLGAGPAGPKPGVITQLERGDEPWVLDAQGAKGKERLRVSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59556 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVAFEDVAVYFTTKEWAIMVPAERALYRDVMLENYEAVAFVAVPPTSKPALVSHLEQGKESCFIRPPGVLSRSDWRAGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59557 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTPVTFEDVVVYFTAAEWVHLTNWQRDFYQAVMMETYELVASVAGDGVPMAEDEEGGVERPVWQYIPRGKRRRKTPQPRADGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59558 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAFEDVAVYFSQEEWGLLDTAQRALYRRVMLDNFALVASLGLSTSRPRVVIQLERGEEPWVPSGTDTTLSRTTYRRRNPGSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59559 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGSVTFRDVAIDFSQEEWKWLQPAQRDLYRRVMLENYGHLVSLGLSISKPDVVSLLEQGKEPWLGKRNVKRDLFSASESSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59560 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQEPVTFKDVAVDFTQEEWGQLDLVQRTLYRDVMLETYGHLLSVGNQIAKPEVISLLEQGEEPWSVEQACPQHTCPEWMRNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59561 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGWPESVTFEDVAVYFTQNQWASLDPAQRALYGEVMLENYANVASLVAFPFPKPALISHLERGEAPWGPDPWDTEIPRGISQGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59562 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQSPLTFGDVAVEFSGEEWAWLDSAQRSLHRSVMLENYRNLASLGLCLSKPEMISSLEQRKEPWAVKRKSTRGMHPDSQTLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59563 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQEAVTFKDVAVVFTEEELGLLDPPQRKLYREVMLENFRNLVSVGHSSSKPDVISQLEREEKLCVKEIHTQRGRHSGGRNQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59564 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKEAFVAFGDVAVDFTQEEWRLLSPAQRTLHREVMLETYNHLVSLEIPFSKPKLISQLERGEEPWIEERQRPLGLCPASRPTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59565 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQAEVTFEDVAVLFSREEWGRLGPAQRGLYRDVMLETYRNLVSLGAGPAGPKPGVITQLERGDEPWVLDAQGAKGKERLRVSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59566 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVAFEDVAVYFTTKEWAIMVPAERALYRDVMLENYEAVAFVAVPPTSKPALVSHLEQGKESCFIRPPGVLSRSDWRAGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59567 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSTPVTFEDVVVYFTAAEWVHLTNWQRDFYQAVMMETYELVASVAGDGVPMAEDEEGGVERPVWQYIPRGKRRRKTPQPRADGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59568 - DNA, 44 bp, synthetic construct
  source 1..44: mol_type = other DNA
aaataagagagaaaagaagagtaagaagaaatataagagccacc

SEQ ID NO: 59569 - DNA, 57 bp, synthetic construct
  source 1..57: mol_type = other DNA
atggcccctaagaagaagcgtaaagtgagccggggcggcagcggcggcggcagcgcc

SEQ ID NO: 59570 - DNA, 2931 bp, synthetic construct
  source 1..2931: mol_type = other DNA
caggagattaaacggatcaacaagatcagaagaagacttgtgaaagacagcaacaccaagaaggccggcaagacaggccccatgaaaaccctgctggttagagtgatgacacccgatctgagagagcggctggaaaacctgagaaagaagcctgaaaatatcccccagcccatcagcaatacatctagagccaacctgaataagctgctgaccgattacaccgaaatgaagaaggcgatcctgcatgtgtactgggaagagttccagaaggaccctgtgggcctgatgagccgggtggcccagcctgccagcaagaagatcgatcagaacaagctgaaacctgagatggacgagaagggcaacctgaccaccgccggctttgcctgctctcagtgtggccagcccctgttcgtgtacaagctggagcaggtgtctgagaagggcaaggcttacaccaactacttcggacggtgcaatgtggccgagcacgaaaagctgatcctgctggcccagctgaagcccgagaaggatagcgacgaagccgtgacatatagcctgggaaagtttgggcagagggccctggatttctacagcattcatgtgaccaaggagtccacccaccccgtgaagcccctggcccagatcgccggaaacagatacgcctccggacctgtgggaaaggccctgagcgacgcatgtatgggcacaatcgcctccttcctgtctaagtaccaggacatcatcatcgaacaccagaaggtggtgaagggcaaccagaagagactggagagcctgcgggagctggccggcaaggaaaacctggaataccctagcgtgaccctgccacctcagcctcacaccaaggagggcgttgatgcctacaacgaagtgatcgcccgggtgcgaatgtgggtgaacctgaacctgtggcagaagctgaagctaagcagagatgatgccaagcctctgctgagactgaagggattcccttcctttcctctggtcgagagacaggccaacgaagtggactggtgggacatggtgtgtaacgtgaagaagctgatcaacgagaaaaaggaggatggcaaggtgttttggcagaatctggctggctacaagagacaggaagccctgagaccatacctgagcagcgaggaagatcggaagaagggaaagaaattcgctcggtaccagctgggcgacctgctgctgcacctggaaaagaagcacggcgaggactggggaaaggtgtacgacgaggcctgggagcggattgacaagaaagtggaaggcctgagcaagcacatcaagctggaagaggaacggagaagcgaggacgcccagagcaaggccgccctgaccgactggctgcgggctaaggccagcttcgtgatcgagggcctgaaggaggccgacaaggacgagttctgcagatgcgagctgaagctgcagaagtggtacggggacctgcggggaaagcccttcgccatcgaagccgagaacagcatcctggacatcagcggcttcagcaagcagtacaactgtgccttcatctggcagaaggacggcgtgaagaagctgaacctgtacctgatcatcaactacttcaagggcggcaagctgcggttcaagaagatcaaacctgaagccttcgaagccaacagattctacaccgtgatcaacaaaaagagcggcgagatcgtgcccatggaggtgaacttcaacttcgacgaccccaacctgatcatcctgcctctggcctttggcaagagacagggcagagaattcatctggaacgacctgctgtccctggaaaccggcagcctgaagctggccaacggaagagtgatcgagaagacactgtacaacagaagaacccggcaggatgagcctgccctgttcgtggccctgaccttcgagcggcgggaggtcctggactcctccaatatcaaaccaatgaacctgatcggcgtggcaagaggcgaaaacatccccgccgtgatcgccctgaccgaccccgagggctgcccactgagccggtttaaggatagcctgggaaacccaacccacatcctgagaatcggcgagagctataaggagaagcagcggaccatccaggccaagaaggaggtggagcagcggagagccggcggctacagccggaagtacgccagcaaagccaagaatctggcagacgatatggtgagaaacaccgctagagatctgctgtactacgccgtgacccaggatgccatgctgatcttcgccaacctgagccggggcttcggccggcagggcaagcggaccttcatggccgagagacagtacacacggatggaggactggctgaccgccaagctggcctacgagggcctgagcaagacctacctgtccaagacactggcccagtacacctccaagacatgcagcaactgtgggtttaccatcaccagcgccgactacgacagggtgctggagaagctgaagaagacagcaacaggctggatgaccacaattaacggcaaggagctgaaggtggagggccagattacctactacaacagatacaagagacagaacgtagtcaaggacctgtccgtcgagctggatagactgagcgaagaatctgtgaacaacgacatctcctcctggacaaagggcagaagcggagaagctctgagcctcctgaagaaaagattctcccatagacccgtgcaggagaagttcgtgtgcctgaactgcggcttcgagacacacgcagccgagcaagccgccctgaacatcgccagatcctggctgttcctgcggagccaggagtacaagaaataccagacaaacaagacaaccggcaacaccgataagagagccttcgtcgagacctggcagtccttttaccggaagaagcttaaggaggtgtggaaacctgccgtg

SEQ ID NO: 59571 - DNA, 33 bp, synthetic construct
  source 1..33: mol_type = other DNA
cggtctggcggatctggcggaggctccacaagc

SEQ ID NO: 59572 - DNA, 300 bp, synthetic construct
  source 1..300: mol_type = other DNA
atgaacaactcccagggcagagtgaccttcgaggacgtgaccgtgaattttacacagggagagtggcagagactgaaccccgagcagagaaacctgtaccgggatgtgatgctggaaaactacagcaatctggtgtccgtgggccagggcgagaccacaaagcctgacgtgatcctgcgtctggagcagggcaaggaaccctggctggaggaggaggaggtgctgggaagcggacgggccgagaagaacggcgacatcggcggacagatctggaagcctaaggacgtgaaagaaagcctg

SEQ ID NO: 59573 - DNA, 27 bp, synthetic construct
  source 1..27: mol_type = other DNA
accagccccaagaaaaagagaaaagtc

SEQ ID NO: 59574 - DNA, 48 bp, synthetic construct
  source 1..48: mol_type = other DNA
gactacaaggatgacgatgacaaggactacaaggatgacgacgacaag

SEQ ID NO: 59575 - DNA, 26 bp, synthetic construct
  source 1..26: mol_type = other DNA
taatagataagcggccgcttaattaa

SEQ ID NO: 59576 - DNA, 93 bp, synthetic construct
  source 1..93: mol_type = other DNA
gctgccttctgcggggcttgccttctggccatgcccttcttctctcccttgcacctgtacctcttggtctttgaataaagcctgagtaggaag

SEQ ID NO: 59577 - skipped

SEQ ID NO: 59578 - DNA, 80 bp, synthetic construct
  source 1..80: mol_type = other DNA
aaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59579 - DNA, 60 bp, synthetic construct
  source 1..60: mol_type = other DNA
atggcccctaagaagaagcgtaaagtgagccgggtgaacggcagcggcagcggcggcggc

SEQ ID NO: 59580 - DNA, 906 bp, synthetic construct
  source 1..906: mol_type = other DNA
atgaaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 59581 - DNA, 81 bp, synthetic construct
  source 1..81: mol_type = other DNA
agcagcggcaacagcaacgccaacagccggggccccagcttctctagcggcctggtgccactgtccctgagagggagccac

SEQ ID NO: 59582 - DNA, 645 bp, synthetic construct
  source 1..645: mol_type = other DNA
atgggccccatggagatctacaaaaccgtgagcgcctggaagcggcagcctgtgcgcgtgctgagcctgtttcggaatatcgataaagtcctgaaaagcctgggattcctggagagcggctctggctccggcggtggcaccctgaagtacgtggaggatgtgacaaacgtggtcagacgggatgtggagaagtggggccccttcgatctggtgtacggcagcacccaacccctgggcagctcttgtgaccggtgccctggctggtacatgtttcagttccaccggatcctgcagtacgccctgccgagacaggagtcccagcggccattcttttggattttcatggacaacttgctgctgaccgaggatgaccaggaaactaccactcggttcctgcagaccgaagccgtgaccctgcaggacgtgagaggccgggactaccagaacgccatgcgggtgtggtccaacatccctggactgaaaagcaagcacgcacctctgacccctaaagaagaggagtacctgcaggcccaggtgcggagcagaagcaagctggacgcccctaaggtggatctgctggtgaagaattgcctcctgcccctgagagagtacttcaagtatttcagccagaatagtctgcccctg

SEQ ID NO: 59583 - DNA, 264 bp, synthetic construct
  source 1..264: mol_type = other DNA
ggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgagggcggctctggcggcggcagcgcc

SEQ ID NO: 59584 - RNA, 3644 nt, synthetic construct
  source 1..3644: mol_type = other RNA
  modified_base 1..3644: mod_base = m1f
aaanaagagagaaaagaagagnaagaagaaananaagagccaccanggccccnaagaagaagcgnaaagngagccggggcggcagcggcggcggcagcgcccaggagannaaacggancaacaagancagaagaagacnngngaaagacagcaacaccaagaaggccggcaagacaggccccangaaaacccngcnggnnagagngangacacccgancngagagagcggcnggaaaaccngagaaagaagccngaaaanancccccagcccancagcaanacancnagagccaaccngaanaagcngcngaccgannacaccgaaangaagaaggcganccngcangngnacngggaagagnnccagaaggacccngngggccngangagccgggnggcccagccngccagcaagaagancgancagaacaagcngaaaccngaganggacgagaagggcaaccngaccaccgccggcnnngccngcncncagngnggccagccccngnncgngnacaagcnggagcaggngncngagaagggcaaggcnnacaccaacnacnncggacggngcaangnggccgagcacgaaaagcnganccngcnggcccagcngaagcccgagaagganagcgacgaagccgngacananagccngggaaagnnngggcagagggcccnggannncnacagcanncangngaccaaggagnccacccaccccgngaagccccnggcccagancgccggaaacaganacgccnccggaccngngggaaaggcccngagcgacgcangnangggcacaancgccnccnnccngncnaagnaccaggacancancancgaacaccagaaggnggngaagggcaaccagaagagacnggagagccngcgggagcnggccggcaaggaaaaccnggaanacccnagcgngacccngccaccncagccncacaccaaggagggcgnngangccnacaacgaagngancgcccgggngcgaangngggngaaccngaaccngnggcagaagcngaagcnaagcagagangangccaagccncngcngagacngaaggganncccnnccnnnccncnggncgagagacaggccaacgaagnggacnggngggacanggngngnaacgngaagaagcngancaacgagaaaaaggagganggcaaggngnnnnggcagaancnggcnggcnacaagagacaggaagcccngagaccanaccngagcagcgaggaagancggaagaagggaaagaaanncgcncggnaccagcngggcgaccngcngcngcaccnggaaaagaagcacggcgaggacnggggaaaggngnacgacgaggccngggagcgganngacaagaaagnggaaggccngagcaagcacancaagcnggaagaggaacggagaagcgaggacgcccagagcaaggccgcccngaccgacnggcngcgggcnaaggccagcnncgngancgagggccngaaggaggccgacaaggacgagnncngcagangcgagcngaagcngcagaagnggnacggggaccngcggggaaagcccnncgccancgaagccgagaacagcanccnggacancagcggcnncagcaagcagnacaacngngccnncancnggcagaaggacggcgngaagaagcngaaccngnaccngancancaacnacnncaagggcggcaagcngcggnncaagaagancaaaccngaagccnncgaagccaacaganncnacaccgngancaacaaaaagagcggcgagancgngcccanggaggngaacnncaacnncgacgaccccaaccngancanccngccncnggccnnnggcaagagacagggcagagaanncancnggaacgaccngcngncccnggaaaccggcagccngaagcnggccaacggaagagngancgagaagacacngnacaacagaagaacccggcaggangagccngcccngnncgnggcccngaccnncgagcggcgggaggnccnggacnccnccaanancaaaccaangaaccngancggcgnggcaagaggcgaaaacanccccgccgngancgcccngaccgaccccgagggcngcccacngagccggnnnaagganagccngggaaacccaacccacanccngagaancggcgagagcnanaaggagaagcagcggaccanccaggccaagaaggaggnggagcagcggagagccggcggcnacagccggaagnacgccagcaaagccaagaancnggcagacgananggngagaaacaccgcnagagancngcngnacnacgccgngacccaggangccangcngancnncgccaaccngagccggggcnncggccggcagggcaagcggaccnncanggccgagagacagnacacacgganggaggacnggcngaccgccaagcnggccnacgagggccngagcaagaccnaccngnccaagacacnggcccagnacaccnccaagacangcagcaacngngggnnnaccancaccagcgccgacnacgacagggngcnggagaagcngaagaagacagcaacaggcnggangaccacaannaacggcaaggagcngaaggnggagggccagannaccnacnacaacaganacaagagacagaacgnagncaaggaccngnccgncgagcngganagacngagcgaagaancngngaacaacgacancnccnccnggacaaagggcagaagcggagaagcncngagccnccngaagaaaaganncncccanagacccgngcaggagaagnncgngngccngaacngcggcnncgagacacacgcagccgagcaagccgcccngaacancgccaganccnggcngnnccngcggagccaggagnacaagaaanaccagacaaacaagacaaccggcaacaccganaagagagccnncgncgagaccnggcagnccnnnnaccggaagaagcnnaaggaggngnggaaaccngccgngcggncnggcggancnggcggaggcnccacaagcangaacaacncccagggcagagngaccnncgaggacgngaccgngaannnnacacagggagagnggcagagacngaaccccgagcagagaaaccngnaccgggangngangcnggaaaacnacagcaancnggngnccgngggccagggcgagaccacaaagccngacgnganccngcgncnggagcagggcaaggaacccnggcnggaggaggaggaggngcngggaagcggacgggccgagaagaacggcgacancggcggacagancnggaagccnaaggacgngaaagaaagccngaccagccccaagaaaaagagaaaagncgacnacaaggangacgangacaaggacnacaaggangacgacgacaagnaanaganaagcggccgcnnaannaagcngccnncngcggggcnngccnncnggccangcccnncnncncncccnngcaccngnaccncnnggncnnngaanaaagccngagnaggaagncnagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59585 - RNA, 5543 nt, synthetic construct
  source 1..5543: mol_type = other RNA
  modified_base 1..5543: mod_base = m1f
aaanaagagagaaaagaagagnaagaagaaananaagagccaccanggccccnaagaagaagcgnaaagngagccgggngaacggcagcggcagcggcggcggcangaaccacgaccaggagnncgaccccccnaaggngnacccncccgnccccgccgagaagagaaagcccanccgggnccngagccngnncganggcancgccaccggncngcnggngcngaaggaccngggcanccaggngganaggnacanngccnccgaggngngcgaggacnccancaccgngggaanggngcgncancagggcaagancangnacgngggcgacgngcggagcgngacacagaagcananccaggagnggggcccnnncgaccnggngancggcggcagcccnngcaangaccngagcancgngaacccagcccggaagggccngnacgagggaaccggcagacngnncnncgagnnnnacagacngcngcacgacgcccggccnaaggaaggcgacgaccggcccnncnnnnggcngnncgagaangnggnggccangggagncagcgacaagcggganannagccggnnccnggagagcaaccccgngangancgangccaaggaagngagcgccgcccaccgggccaganacnncnggggcaancngccnggcangaacagaccccnggccagcaccgngaacgacaagcnggagcngcaggagngccnggagcacggccggancgccaagnncagcaaggngagaaccancaccacccgaagcaacagcancaaacaaggcaaggaccagcacnnnccngngnncangaacgagaaggaggacanccngnggngnaccgaganggagagagngnncgggnncccagnccacnacacagangncagcaacangncnagacnggccagacagagacngcngggaagaagcnggnccgncccngngancagacaccngnncgccccncngaaggagnacnncgccngcgngagcagcggcaacagcaacgccaacagccggggccccagcnncncnagcggccnggngccacngncccngagagggagccacangggccccanggagancnacaaaaccgngagcgccnggaagcggcagccngngcgcgngcngagccngnnncggaanancganaaagnccngaaaagccngggannccnggagagcggcncnggcnccggcggnggcacccngaagnacgnggaggangngacaaacgnggncagacgggangnggagaagnggggccccnncgancnggngnacggcagcacccaaccccngggcagcncnngngaccggngcccnggcnggnacangnnncagnnccaccgganccngcagnacgcccngccgagacaggagncccagcggccanncnnnnggannnncanggacaacnngcngcngaccgaggangaccaggaaacnaccacncggnnccngcagaccgaagccgngacccngcaggacgngagaggccgggacnaccagaacgccangcgggngnggnccaacancccnggacngaaaagcaagcacgcaccncngaccccnaaagaagaggagnaccngcaggcccaggngcggagcagaagcaagcnggacgccccnaaggnggancngcnggngaagaanngccnccngccccngagagagnacnncaagnannncagccagaanagncngccccngggcggcccaagcagcggcgccccnccncccagcggcggcagcccagccggcnccccaaccncnaccgaggagggcaccncngagnccgccacccccgagagcggcccnggcaccnccaccgagcccagcgagggcagcgcacccggcagcccngccggcagccccaccnccacagaggagggaaccagcaccgagcccagcgaaggcagcgccccaggcaccagcaccgagccnagngagggcggcncnggcggcggcagcgcccaggagannaaacggancaacaagancagaagaagacnngngaaagacagcaacaccaagaaggccggcaagacaggccccangaaaacccngcnggnnagagngangacacccgancngagagagcggcnggaaaaccngagaaagaagccngaaaanancccccagcccancagcaanacancnagagccaaccngaanaagcngcngaccgannacaccgaaangaagaaggcganccngcangngnacngggaagagnnccagaaggacccngngggccngangagccgggnggcccagccngccagcaagaagancgancagaacaagcngaaaccngaganggacgagaagggcaaccngaccaccgccggcnnngccngcncncagngnggccagccccngnncgngnacaagcnggagcaggngncngagaagggcaaggcnnacaccaacnacnncggacggngcaangnggccgagcacgaaaagcnganccngcnggcccagcngaagcccgagaagganagcgacgaagccgngacananagccngggaaagnnngggcagagggcccnggannncnacagcanncangngaccaaggagnccacccaccccgngaagccccnggcccagancgccggaaacaganacgccnccggaccngngggaaaggcccngagcgacgcangnangggcacaancgccnccnnccngncnaagnaccaggacancancancgaacaccagaaggnggngaagggcaaccagaagagacnggagagccngcgggagcnggccggcaaggaaaaccnggaanacccnagcgngacccngccaccncagccncacaccaaggagggcgnngangccnacaacgaagngancgcccgggngcgaangngggngaaccngaaccngnggcagaagcngaagcnaagcagagangangccaagccncngcngagacngaaggganncccnnccnnnccncnggncgagagacaggccaacgaagnggacnggngggacanggngngnaacgngaagaagcngancaacgagaaaaaggagganggcaaggngnnnnggcagaancnggcnggcnacaagagacaggaagcccngagaccanaccngagcagcgaggaagancggaagaagggaaagaaanncgcncggnaccagcngggcgaccngcngcngcaccnggaaaagaagcacggcgaggacnggggaaaggngnacgacgaggccngggagcgganngacaagaaagnggaaggccngagcaagcacancaagcnggaagaggaacggagaagcgaggacgcccagagcaaggccgcccngaccgacnggcngcgggcnaaggccagcnncgngancgagggccngaaggaggccgacaaggacgagnncngcagangcgagcngaagcngcagaagnggnacggggaccngcggggaaagcccnncgccancgaagccgagaacagcanccnggacancagcggcnncagcaagcagnacaacngngccnncancnggcagaaggacggcgngaagaagcngaaccngnaccngancancaacnacnncaagggcggcaagcngcggnncaagaagancaaaccngaagccnncgaagccaacaganncnacaccgngancaacaaaaagagcggcgagancgngcccanggaggngaacnncaacnncgacgaccccaaccngancanccngccncnggccnnnggcaagagacagggcagagaanncancnggaacgaccngcngncccnggaaaccggcagccngaagcnggccaacggaagagngancgagaagacacngnacaacagaagaacccggcaggangagccngcccngnncgnggcccngaccnncgagcggcgggaggnccnggacnccnccaanancaaaccaangaaccngancggcgnggcaagaggcgaaaacanccccgccgngancgcccngaccgaccccgagggcngcccacngagccggnnnaagganagccngggaaacccaacccacanccngagaancggcgagagcnanaaggagaagcagcggaccanccaggccaagaaggaggnggagcagcggagagccggcggcnacagccggaagnacgccagcaaagccaagaancnggcagacgananggngagaaacaccgcnagagancngcngnacnacgccgngacccaggangccangcngancnncgccaaccngagccggggcnncggccggcagggcaagcggaccnncanggccgagagacagnacacacgganggaggacnggcngaccgccaagcnggccnacgagggccngagcaagaccnaccngnccaagacacnggcccagnacaccnccaagacangcagcaacngngggnnnaccancaccagcgccgacnacgacagggngcnggagaagcngaagaagacagcaacaggcnggangaccacaannaacggcaaggagcngaaggnggagggccagannaccnacnacaacaganacaagagacagaacgnagncaaggaccngnccgncgagcngganagacngagcgaagaancngngaacaacgacancnccnccnggacaaagggcagaagcggagaagcncngagccnccngaagaaaaganncncccanagacccgngcaggagaagnncgngngccngaacngcggcnncgagacacacgcagccgagcaagccgcccngaacancgccaganccnggcngnnccngcggagccaggagnacaagaaanaccagacaaacaagacaaccggcaacaccganaagagagccnncgncgagaccnggcagnccnnnnaccggaagaagcnnaaggaggngnggaaaccngccgngcggncnggcggancnggcggaggcnccacaagcangaacaacncccagggcagagngaccnncgaggacgngaccgngaannnnacacagggagagnggcagagacngaaccccgagcagagaaaccngnaccgggangngangcnggaaaacnacagcaancnggngnccgngggccagggcgagaccacaaagccngacgnganccngcgncnggagcagggcaaggaacccnggcnggaggaggaggaggngcngggaagcggacgggccgagaagaacggcgacancggcggacagancnggaagccnaaggacgngaaagaaagccngaccagccccaagaaaaagagaaaagncgacnacaaggangacgangacaaggacnacaaggangacgacgacaagnaanaganaagcggccgcnnaannaagcngccnncngcggggcnngccnncnggccangcccnncnncncncccnngcaccngnaccncnnggncnnngaanaaagccngagnaggaagncnagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59586 - protein, 1116 aa, synthetic construct; identical to SEQ ID NO: 59438

SEQ ID NO: 59587 - RNA, 20 nt, synthetic construct
  source 1..20: mol_type = other RNA
tcctggcttcctggtgaaga

SEQ ID NO: 59588 - RNA, 20 nt, synthetic construct
  source 1..20: mol_type = other RNA
gcctcgccctccccagacag

SEQ ID NO: 59589 - RNA, 20 nt, synthetic construct
  source 1..20: mol_type = other RNA
cgctacctgcctaaactttg

SEQ ID NO: 59590 - RNA, 20 nt, synthetic construct
  source 1..20: mol_type = other RNA
ccctccaacaatattaacta

SEQ ID NO: 59591 - RNA, 20 nt, synthetic construct
  source 1..20: mol_type = other RNA
ggggtctcccagccacccct

SEQ ID NO: 59592 - RNA, 20 nt, synthetic construct
  source 1..20: mol_type = other RNA
cccctcttaatccccactcc

SEQ ID NO: 59593 - RNA, 20 nt, synthetic construct
  source 1..20: mol_type = other RNA
ctctctctttctgaggctag

SEQ ID NO: 59594 - RNA, 20 nt, synthetic construct
  source 1..20: mol_type = other RNA
taatctccatcctcgtcctg

SEQ ID NO: 59595 - DNA, 14 bp, synthetic construct
  source 1..14: mol_type = other DNA
gaccggccgccacc

SEQ ID NO: 59596 - DNA, 60 bp, synthetic construct
  source 1..60: mol_type = other DNA
atggccccaaagaagaagcggaaggtctctagagttaacggatcaggctctggaggtgga

SEQ ID NO: 59597 - DNA, 906 bp, synthetic construct
  source 1..906: mol_type = other DNA
atgaaccatgaccaggaatttgaccccccaaaggtttacccacctgtgccagctgagaagaggaagcccatccgcgtgctgtctctctttgatgggattgctacagggctcctggtgctgaaggacctgggcatccaagtggaccgctacatcgcctccgaggtgtgtgaggactccatcacggtgggcatggtgcggcaccagggaaagatcatgtacgtcggggacgtccgcagcgtcacacagaagcatatccaggagtggggcccattcgacctggtgattggaggcagtccctgcaacgacctctccattgtcaaccctgcccgcaagggactttatgagggtactggccgcctcttctttgagttctaccgcctcctgcatgatgcgcggcccaaggagggagatgatcgccccttcttctggctctttgagaatgtggtggccatgggcgttagtgacaagagggacatctcgcgatttcttgagtctaaccccgtgatgattgacgccaaagaagtgtctgctgcacacagggcccgttacttctggggtaaccttcctggcatgaacaggcctttggcatccactgtgaatgataagctggagctgcaagagtgtctggagcacggcagaatagccaagttcagcaaagtgaggaccattaccaccaggtcaaactctataaagcagggcaaagaccagcatttccccgtcttcatgaacgagaaggaggacatcctgtggtgcactgaaatggaaagggtgtttggcttccccgtccactacacagacgtgtccaacatgagccgcttggcgaggcagagactgctgggccggtcgtggagcgtgccggtcatccgccacctcttcgctccgctgaaggaatattttgcttgtgtg

SEQ ID NO: 59598 - DNA, 81 bp, synthetic construct; identical to SEQ ID NO: 57622
  source 1..81: mol_type = other DNA

SEQ ID NO: 59599 - DNA, 240 bp, synthetic construct; identical to SEQ ID NO: 57620
  source 1..240: mol_type = other DNA

SEQ ID NO: 59600 - DNA, 24 bp, synthetic construct
  source 1..24: mol_type = other DNA
ggcggttccggcggaggaagcgct

SEQ ID NO: 59601 - DNA, 2931 bp, synthetic construct; identical to SEQ ID NO: 57596
  source 1..2931: mol_type = other DNA

SEQ ID NO: 59602 - DNA, 33 bp, synthetic construct
  source 1..33: mol_type = other DNA
cgatcgggcggttccggcggaggttccactagt

SEQ ID NO: 59603 - DNA, 300 bp, synthetic construct; identical to SEQ ID NO: 57591
  source 1..300: mol_type = other DNA

SEQ ID NO: 59604 - DNA, 27 bp, synthetic construct
  source 1..27: mol_type = other DNA
actagtccaaaaaagaagagaaaggta

SEQ ID NO: 59605 - DNA, 48 bp, synthetic construct
  source 1..48: mol_type = other DNA
gattacaaagatgacgatgacaaagactacaaggatgatgatgataag

SEQ ID NO: 59606 - DNA, 11 bp, synthetic construct
  source 1..11: mol_type = other DNA
ggatccggctg

SEQ ID NO: 59607 - DNA, 121 bp, synthetic construct
  source 1..121: mol_type = other DNA
aaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59608 - DNA, 33 bp, synthetic construct
  source 1..33: mol_type = other DNA
atggccccaaagaagaagcggaaggtctctaga

SEQ ID NO: 59609 - DNA, 21 bp, synthetic construct
  source 1..21: mol_type = other DNA
ccaaaaaagaagagaaaggta

SEQ ID NO: 59610 - RNA, 5441 nt, synthetic construct
  source 1..5441: mol_type = other RNA
  modified_base 1..5441: mod_base = m1f
gaccggccgccaccanggccccaaagaagaagcggaaggncncnagagnnaacggancaggcncnggaggnggaangaaccangaccaggaannngaccccccaaaggnnnacccaccngngccagcngagaagaggaagcccanccgcgngcngncncncnnnganggganngcnacagggcnccnggngcngaaggaccngggcanccaagnggaccgcnacancgccnccgaggngngngaggacnccancacggngggcanggngcggcaccagggaaagancangnacgncggggacgnccgcagcgncacacagaagcananccaggagnggggcccanncgaccnggngannggaggcagncccngcaacgaccncnccanngncaacccngcccgcaagggacnnnangagggnacnggccgccncnncnnngagnncnaccgccnccngcangangcgcggcccaaggagggagangancgccccnncnncnggcncnnngagaangnggnggccangggcgnnagngacaagagggacancncgcgannncnngagncnaaccccgnganganngacgccaaagaagngncngcngcacacagggcccgnnacnncnggggnaaccnnccnggcangaacaggccnnnggcanccacngngaanganaagcnggagcngcaagagngncnggagcacggcagaanagccaagnncagcaaagngaggaccannaccaccaggncaaacncnanaaagcagggcaaagaccagcannnccccgncnncangaacgagaaggaggacanccngnggngcacngaaanggaaagggngnnnggcnnccccgnccacnacacagacgngnccaacangagccgcnnggcgaggcagagacngcngggccggncgnggagcgngccggncanccgccaccncnncgcnccgcngaaggaanannnngcnngngngncnagcggcaanagnaacgcnaacagccgcgggccgagcnncagcagcggccnggngccgnnaagcnngcgcggcagccanangggcccnanggagananacaagacagngncngcanggaagagacagccagngcgggnacngagccncnncagaaacancgacaaggnacnaaagagnnngggcnncnnggaaagcggnncnggnncngggggaggaacgcngaagnacgnggaagangncacaaangncgngaggagggacgnggagaaanggggccccnnngaccnggngnacggcncgacgcagccccnaggcagcncnngngancgcngncccggcnggnacangnnccagnnccaccgganccngcagnangcgcngccncgccaggagagncagcggcccnncnncnggananncanggacaancngcngcngacngaggangaccaagagacaacnacccgcnnccnncagacagaggcngngacccnccaggangnccgnggcagagacnaccagaangcnangcgggngnggagcaacannccagggcngaagagcaagcangcgccccngaccccaaaggaagaagagnancngcaagcccaagncagaagcaggagcaagcnggacgccccgaaagnngaccnccnggngaagaacngccnncncccgcngagagagnacnncaagnannnnncncaaaacncacnnccncnnggagggccgagcncnggcgcacccccaccaagnggagggncnccngccgggnccccaacancnacngaagaaggcaccagcgaanccgcaacgcccgagncaggcccnggnaccnccacagaaccancngaaggnagngcgccnggnnccccagcnggaagcccnacnnccaccgaagaaggcacgncaaccgaaccaagngaaggancngccccngggaccagcacngaaccancngagggcggnnccggcggaggaagcgcncaagagancaagagaancaacaagancagaaggagacnggncaaggacagcaacacaaagaaggccggcaagacaggccccangaaaacccngcncgncagagngangaccccngaccngagagagcggcnggaaaaccngagaaagaagcccgagaacancccncagccnancagcaacaccagcagggccaaccngaacaagcngcngaccgacnacaccgagangaagaaagccanccngcacgngnacngggaagagnnccagaaagaccccgngggccngangagcagagnngcncagccngccagcaagaagancgaccagaacaagcngaagcccgaganggacgagaagggcaancngaccacagccggcnnngccngcncncagngnggccagccncngnncgngnacaagcnggaacaggngnccgagaaaggcaaggccnacaccaacnacnncggcagangnaacgnggccgagcacgagaagcnganncngcnggcccagcngaaaccngagaaggacncngangaggccgngaccnacagccngggcaagnnnggacagagagcccnggacnncnacagcanccacgngaccaaagaaagcacacaccccgngaagccccnggcncagancgccggcaanaganacgccncnggaccngngggcaaagcccngnccgangccngcangggaacaancgccagcnnccngagcaagnaccaggacancancancgagcaccagaaggnggncaagggcaaccagaagagacnggaaagccngagggagcnggccggcaaagagaaccnggaanaccccagcgngacccngccnccncagccncacacaaaagaaggcgnggacgccnacaacgaagngancgccagagngagaangngggncaaccngaaccngnggcagaagcngaaacngnccagggacgacgccaagccncngcngagacngaagggcnncccnagcnncccncnggnggaaagacaggccaangaagnggannggngggacanggncngcaacgngaagaagcngancaacgagaagaaagagganggcaaggnnnncnggcagaaccnggccggcnacaagagacaagaagcccngaggccnnaccngagcagcgaagaggaccggaagaagggcaagaagnncgccaganaccagcngggcgaccngcngcngcaccnggaaaagaagcacggcgaggacnggggcaaagngnacgangaggccngggagagaancgacaagaaggnggaaggccngagcaagcacannaagcnggaagaggaaagaaggagcgaggacgcccaancnaaagccgcncngaccgannggcngagagccaaggccagcnnngngancgagggccngaaagaggccgacaaggacgagnncngcagangcgagcngaagcngcagaagnggnacggcgancngagaggcaagcccnncgccanngaggccgagaacagcanccnggacancagcggcnncagcaagcagnacaacngcgccnncannnggcagaaagacggcgncaagaaacngaaccngnaccngancancaannacnncaaaggcggcaagcngcggnncaagaagancaaacccgaggccnncgaggcnaacaganncnacaccgngancaacaaaaagnccggcgagancgngcccanggaagngaacnncaacnncgacgaccccaaccngannanccngccncnggccnncggcaagagacagggcagagagnncancnggaacgancngcngagccnggaaaccggcncncngaagcnggccaanggcagagngancgagaaaacccngnacaacaggagaaccagacaggacgagccngcncngnnngnggcccngaccnncgagagaagagaggngcnggacagcagcaacancaagcccangaaccngancggcgnggcccggggcgagaanancccngcngngancgcccngacagacccngaaggangcccacngagcaganncaaggacncccngggcaacccnacacacanccngagaancggcgagagcnacaaagagaagcagaggacaanccaggccaagaaagaggnggaacagagaagagccggcgganacncnaggaagnacgccagcaaggccaagaancnggccgacgacanggnccgaaacaccgccagagancngcngnacnacgccgngacacaggacgccangcngancnncgcgaancngagcagaggcnncggccggcagggcaagagaaccnnnanggccgagaggcagnacaccagaanggaagannggcncacagcnaaacnggccnacgagggacngagcaagaccnaccngnccaaaacacnggcccagnanaccnccaagaccngcagcaanngcggcnncaccancaccagcgccgacnacgacagagngcnggaaaagcncaagaaaaccgccaccggcnggangaccaccancaacggcaaagagcngaaggnngagggccagancaccnacnacaacaggnacaagaggcagaacgncgngaaggancngagcgnggaacnggacagacngagcgaagagagcgngaacaacgacancagcagcnggacaaagggcagancaggcgaggcncngagccngcngaagaagaggnnnagccacagaccngngcaagagaagnncgngngccngaacngcggcnncgagacacacgccgcngaacaggcngcccngaacanngccagaagcnggcngnnccngagaagccaagagnacaagaagnaccagaccaacaagaccaccggcaacaccgacaagagggccnnngnggaaaccnggcagagcnncnacagaaaaaagcngaaagaagncnggaagcccgccgngcgancgggcggnnccggcggaggnnccacnagnangaacaanncccagggaagagngaccnncgaggangncacngngaacnncacccagggggagnggcagcggcngaancccgaacagagaaacnngnacagggangngangcnggagaannacagcaaccnngncncngngggacaaggggaaaccaccaaacccgangngancnngaggnnggaacaaggaaaggagccanggnnggaggaagaggaagngcngggaagnggccgngcagaaaaaaanggggacannggagggcagannnggaagccaaaggangngaaagagagncncacnagnccaaaaaagaagagaaaggnagannacaaagangacgangacaaagacnacaagganganganganaaggganccggcngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59611 - RNA, 5402 nt, synthetic construct
  source 1..5402: mol_type = other RNA
  modified_base 1..5402: mod_base = m1f
gaccggccgccaccanggccccaaagaagaagcggaaggncncnagaangaaccangaccaggaannngaccccccaaaggnnnacccaccngngccagcngagaagaggaagcccanccgcgngcngncncncnnnganggganngcnacagggcnccnggngcngaaggaccngggcanccaagnggaccgcnacancgccnccgaggngngngaggacnccancacggngggcanggngcggcaccagggaaagancangnacgncggggacgnccgcagcgncacacagaagcananccaggagnggggcccanncgaccnggngannggaggcagncccngcaacgaccncnccanngncaacccngcccgcaagggacnnnangagggnacnggccgccncnncnnngagnncnaccgccnccngcangangcgcggcccaaggagggagangancgccccnncnncnggcncnnngagaangnggnggccangggcgnnagngacaagagggacancncgcgannncnngagncnaaccccgnganganngacgccaaagaagngncngcngcacacagggcccgnnacnncnggggnaaccnnccnggcangaacaggccnnnggcanccacngngaanganaagcnggagcngcaagagngncnggagcacggcagaanagccaagnncagcaaagngaggaccannaccaccaggncaaacncnanaaagcagggcaaagaccagcannnccccgncnncangaacgagaaggaggacanccngnggngcacngaaanggaaagggngnnnggcnnccccgnccacnacacagacgngnccaacangagccgcnnggcgaggcagagacngcngggccggncgnggagcgngccggncanccgccaccncnncgcnccgcngaaggaanannnngcnngngngncnagcggcaanagnaacgcnaacagccgcgggccgagcnncagcagcggccnggngccgnnaagcnngcgcggcagccanangggcccnanggagananacaagacagngncngcanggaagagacagccagngcgggnacngagccncnncagaaacancgacaaggnacnaaagagnnngggcnncnnggaaagcggnncnggnncngggggaggaacgcngaagnacgnggaagangncacaaangncgngaggagggacgnggagaaanggggccccnnngaccnggngnacggcncgacgcagccccnaggcagcncnngngancgcngncccggcnggnacangnnccagnnccaccgganccngcagnangcgcngccncgccaggagagncagcggcccnncnncnggananncanggacaancngcngcngacngaggangaccaagagacaacnacccgcnnccnncagacagaggcngngacccnccaggangnccgnggcagagacnaccagaangcnangcgggngnggagcaacannccagggcngaagagcaagcangcgccccngaccccaaaggaagaagagnancngcaagcccaagncagaagcaggagcaagcnggacgccccgaaagnngaccnccnggngaagaacngccnncncccgcngagagagnacnncaagnannnnncncaaaacncacnnccncnnggcggnnccggcggaggaangaacaanncccagggaagagngaccnncgaggangncacngngaacnncacccagggggagnggcagcggcngaancccgaacagagaaacnngnacagggangngangcnggagaannacagcaaccnngncncngngggacaaggggaaaccaccaaacccgangngancnngaggnnggaacaaggaaaggagccanggnnggaggaagaggaagngcngggaagnggccgngcagaaaaaaanggggacannggagggcagannnggaagccaaaggangngaaagagagncncggagggccgagcncnggcgcacccccaccaagnggagggncnccngccgggnccccaacancnacngaagaaggcaccagcgaanccgcaacgcccgagncaggcccnggnaccnccacagaaccancngaaggnagngcgccnggnnccccagcnggaagcccnacnnccaccgaagaaggcacgncaaccgaaccaagngaaggancngccccngggaccagcacngaaccancngagcaagagancaagagaancaacaagancagaaggagacnggncaaggacagcaacacaaagaaggccggcaagacaggccccangaaaacccngcncgncagagngangaccccngaccngagagagcggcnggaaaaccngagaaagaagcccgagaacancccncagccnancagcaacaccagcagggccaaccngaacaagcngcngaccgacnacaccgagangaagaaagccanccngcacgngnacngggaagagnnccagaaagaccccgngggccngangagcagagnngcncagccngccagcaagaagancgaccagaacaagcngaagcccgaganggacgagaagggcaancngaccacagccggcnnngccngcncncagngnggccagccncngnncgngnacaagcnggaacaggngnccgagaaaggcaaggccnacaccaacnacnncggcagangnaacgnggccgagcacgagaagcnganncngcnggcccagcngaaaccngagaaggacncngangaggccgngaccnacagccngggcaagnnnggacagagagcccnggacnncnacagcanccacgngaccaaagaaagcacacaccccgngaagccccnggcncagancgccggcaanaganacgccncnggaccngngggcaaagcccngnccgangccngcangggaacaancgccagcnnccngagcaagnaccaggacancancancgagcaccagaaggnggncaagggcaaccagaagagacnggaaagccngagggagcnggccggcaaagagaaccnggaanaccccagcgngacccngccnccncagccncacacaaaagaaggcgnggacgccnacaacgaagngancgccagagngagaangngggncaaccngaaccngnggcagaagcngaaacngnccagggacgacgccaagccncngcngagacngaagggcnncccnagcnncccncnggnggaaagacaggccaangaagnggannggngggacanggncngcaacgngaagaagcngancaacgagaagaaagagganggcaaggnnnncnggcagaaccnggccggcnacaagagacaagaagcccngaggccnnaccngagcagcgaagaggaccggaagaagggcaagaagnncgccaganaccagcngggcgaccngcngcngcaccnggaaaagaagcacggcgaggacnggggcaaagngnacgangaggccngggagagaancgacaagaaggnggaaggccngagcaagcacannaagcnggaagaggaaagaaggagcgaggacgcccaancnaaagccgcncngaccgannggcngagagccaaggccagcnnngngancgagggccngaaagaggccgacaaggacgagnncngcagangcgagcngaagcngcagaagnggnacggcgancngagaggcaagcccnncgccanngaggccgagaacagcanccnggacancagcggcnncagcaagcagnacaacngcgccnncannnggcagaaagacggcgncaagaaacngaaccngnaccngancancaannacnncaaaggcggcaagcngcggnncaagaagancaaacccgaggccnncgaggcnaacaganncnacaccgngancaacaaaaagnccggcgagancgngcccanggaagngaacnncaacnncgacgaccccaaccngannanccngccncnggccnncggcaagagacagggcagagagnncancnggaacgancngcngagccnggaaaccggcncncngaagcnggccaanggcagagngancgagaaaacccngnacaacaggagaaccagacaggacgagccngcncngnnngnggcccngaccnncgagagaagagaggngcnggacagcagcaacancaagcccangaaccngancggcgnggcccggggcgagaanancccngcngngancgcccngacagacccngaaggangcccacngagcaganncaaggacncccngggcaacccnacacacanccngagaancggcgagagcnacaaagagaagcagaggacaanccaggccaagaaagaggnggaacagagaagagccggcgganacncnaggaagnacgccagcaaggccaagaancnggccgacgacanggnccgaaacaccgccagagancngcngnacnacgccgngacacaggacgccangcngancnncgcgaancngagcagaggcnncggccggcagggcaagagaaccnnnanggccgagaggcagnacaccagaanggaagannggcncacagcnaaacnggccnacgagggacngagcaagaccnaccngnccaaaacacnggcccagnanaccnccaagaccngcagcaanngcggcnncaccancaccagcgccgacnacgacagagngcnggaaaagcncaagaaaaccgccaccggcnggangaccaccancaacggcaaagagcngaaggnngagggccagancaccnacnacaacaggnacaagaggcagaacgncgngaaggancngagcgnggaacnggacagacngagcgaagagagcgngaacaacgacancagcagcnggacaaagggcagancaggcgaggcncngagccngcngaagaagaggnnnagccacagaccngngcaagagaagnncgngngccngaacngcggcnncgagacacacgccgcngaacaggcngcccngaacanngccagaagcnggcngnnccngagaagccaagagnacaagaagnaccagaccaacaagaccaccggcaacaccgacaagagggccnnngnggaaaccnggcagagcnncnacagaaaaaagcngaaagaagncnggaagcccgccgngcgancgggcggnnccggcggaggnnccacnagnccaaaaaagaagagaaaggnagannacaaagangacgangacaaagacnacaagganganganganaaggganccggcngaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59612 - DNA, 66 bp, synthetic construct
  source 1..66: mol_type = other DNA
atggcccccgccgccaagagagtgaagctggattcccgggtgaatggcagcggcagcgggggcggc

SEQ ID NO: 59613 - DNA, 33 bp, synthetic construct
  source 1..33: mol_type = other DNA
ggctctcccgccgccaagagagtgaagctggac

SEQ ID NO: 59614 - DNA, 33 bp, synthetic construct
  source 1..33: mol_type = other DNA
atggcccctaagaagaagcgtaaagtgagccgg

SEQ ID NO: 59615 - DNA, 18 bp, synthetic construct
  source 1..18: mol_type = other DNA
ggaggcagcggcggcggc

SEQ ID NO: 59616 - DNA, 240 bp, synthetic construct
  source 1..240: mol_type = other DNA
ggcggcccaagcagcggcgcccctcctcccagcggcggcagcccagccggctccccaacctctaccgaggagggcacctctgagtccgccacccccgagagcggccctggcacctccaccgagcccagcgagggcagcgcacccggcagccctgccggcagccccacctccacagaggagggaaccagcaccgagcccagcgaaggcagcgccccaggcaccagcaccgagcctagtgag

SEQ ID NO: 59617 - DNA, 33 bp, synthetic construct
  source 1..33: mol_type = other DNA
cggtctggcggatctggcggaggctccaccagc

SEQ ID NO: 59618 - DNA, 31 bp, synthetic construct
  source 1..31: mol_type = other DNA
cccaagaaaaagagaaaagtctaatagataa

SEQ ID NO: 59619 - DNA, 79 bp, synthetic construct
  source 1..79: mol_type = other DNA
aaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59620 - DNA, 408 bp, synthetic construct
  source 1..408: mol_type = other DNA
atggaacgcctcgtctacgaggtgcggcagaagtgcagaaacatcgaggacatctgcatctcctgcggatctctgaacgtgaccctggagcacccactgttcatcggcggcatgtgccagaactgtaaaaactgttttctggagtgtgcctatcaatacgacgatgacggctaccagagctactgcaccatctgttgcggcggaagagaggtgctgatgtgtggaaataacaactgctgccggtgcttctgcgtggaatgcgtggacctgctggtgggccccggcgccgcccaggccgctattaaggaagatccttggaactgctacatgtgcggccacaagggcacatacggcctgctgagacggagagaggactggcctagcagactgcagatgttcttcgccaat

SEQ ID NO: 59621 - DNA, 903 bp, synthetic construct
  source 1..903: mol_type = other DNA
aaccacgaccaggagttcgacccccctaaggtgtaccctcccgtccccgccgagaagagaaagcccatccgggtcctgagcctgttcgatggcatcgccaccggtctgctggtgctgaaggacctgggcatccaggtggataggtacattgcctccgaggtgtgcgaggactccatcaccgtgggaatggtgcgtcatcagggcaagatcatgtacgtgggcgacgtgcggagcgtgacacagaagcatatccaggagtggggccctttcgacctggtgatcggcggcagcccttgcaatgacctgagcatcgtgaacccagcccggaagggcctgtacgagggaaccggcagactgttcttcgagttttacagactgctgcacgacgcccggcctaaggaaggcgacgaccggcccttcttttggctgttcgagaatgtggtggccatgggagtcagcgacaagcgggatattagccggttcctggagagcaaccccgtgatgatcgatgccaaggaagtgagcgccgcccaccgggccagatacttctggggcaatctgcctggcatgaacagacccctggccagcaccgtgaacgacaagctggagctgcaggagtgcctggagcacggccggatcgccaagttcagcaaggtgagaaccatcaccacccgaagcaacagcatcaaacaaggcaaggaccagcactttcctgtgttcatgaacgagaaggaggacatcctgtggtgtaccgagatggagagagtgttcgggttcccagtccactacacagatgtcagcaacatgtctagactggccagacagagactgctgggaagaagctggtccgtccctgtgatcagacacctgttcgcccctctgaaggagtacttcgcctgcgtg

SEQ ID NO: 59622 - RNA, 5507 nt, synthetic construct
  source 1..5507: mol_type = other RNA
  modified_base 1..5507: mod_base = m1f
aaanaagagagaaaagaagagnaagaagaaananaagagccaccanggcccccgccgccaagagagngaagcngganncccgggngaanggcagcggcagcgggggcggcangaaccacgaccaggagnncgaccccccnaaggngnacccncccgnccccgccgagaagagaaagcccanccgggnccngagccngnncganggcancgccaccggncngcnggngcngaaggaccngggcanccaggngganaggnacanngccnccgaggngngcgaggacnccancaccgngggaanggngcgncancagggcaagancangnacgngggcgacgngcggagcgngacacagaagcananccaggagnggggcccnnncgaccnggngancggcggcagcccnngcaangaccngagcancgngaacccagcccggaagggccngnacgagggaaccggcagacngnncnncgagnnnnacagacngcngcacgacgcccggccnaaggaaggcgacgaccggcccnncnnnnggcngnncgagaangnggnggccangggagncagcgacaagcggganannagccggnnccnggagagcaaccccgngangancgangccaaggaagngagcgccgcccaccgggccaganacnncnggggcaancngccnggcangaacagaccccnggccagcaccgngaacgacaagcnggagcngcaggagngccnggagcacggccggancgccaagnncagcaaggngagaaccancaccacccgaagcaacagcancaaacaaggcaaggaccagcacnnnccngngnncangaacgagaaggaggacanccngnggngnaccgaganggagagagngnncgggnncccagnccacnacacagangncagcaacangncnagacnggccagacagagacngcngggaagaagcnggnccgncccngngancagacaccngnncgccccncngaaggagnacnncgccngcgngagcagcggcaacagcaacgccaacagccggggccccagcnncncnagcggccnggngccacngncccngagagggagccacangggccccanggagancnacaaaaccgngagcgccnggaagcggcagccngngcgcgngcngagccngnnncggaanancganaaagnccngaaaagccngggannccnggagagcggcncnggcnccggcggnggcacccngaagnacgnggaggangngacaaacgnggncagacgggangnggagaagnggggccccnncgancnggngnacggcagcacccaaccccngggcagcncnngngaccggngcccnggcnggnacangnnncagnnccaccgganccngcagnacgcccngccgagacaggagncccagcggccanncnnnnggannnncanggacaacnngcngcngaccgaggangaccaggaaacnaccacncggnnccngcagaccgaagccgngacccngcaggacgngagaggccgggacnaccagaacgccangcgggngnggnccaacancccnggacngaaaagcaagcacgcaccncngaccccnaaagaagaggagnaccngcaggcccaggngcggagcagaagcaagcnggacgccccnaaggnggancngcnggngaagaanngccnccngccccngagagagnacnncaagnannncagccagaanagncngccccngggcggcccaagcagcggcgccccnccncccagcggcggcagcccagccggcnccccaaccncnaccgaggagggcaccncngagnccgccacccccgagagcggcccnggcaccnccaccgagcccagcgagggcagcgcacccggcagcccngccggcagccccaccnccacagaggagggaaccagcaccgagcccagcgaaggcagcgccccaggcaccagcaccgagccnagngagggcggcncnggcggcggcagcgcccaggagannaaacggancaacaagancagaagaagacnngngaaagacagcaacaccaagaaggccggcaagacaggccccangaaaacccngcnggnnagagngangacacccgancngagagagcggcnggaaaaccngagaaagaagccngaaaanancccccagcccancagcaanacancnagagccaaccngaanaagcngcngaccgannacaccgaaangaagaaggcganccngcangngnacngggaagagnnccagaaggacccngngggccngangagccgggnggcccagccngccagcaagaagancgancagaacaagcngaaaccngaganggacgagaagggcaaccngaccaccgccggcnnngccngcncncagngnggccagccccngnncgngnacaagcnggagcaggngncngagaagggcaaggcnnacaccaacnacnncggacggngcaangnggccgagcacgaaaagcnganccngcnggcccagcngaagcccgagaagganagcgacgaagccgngacananagccngggaaagnnngggcagagggcccnggannncnacagcanncangngaccaaggagnccacccaccccgngaagccccnggcccagancgccggaaacaganacgccnccggaccngngggaaaggcccngagcgacgcangnangggcacaancgccnccnnccngncnaagnaccaggacancancancgaacaccagaaggnggngaagggcaaccagaagagacnggagagccngcgggagcnggccggcaaggaaaaccnggaanacccnagcgngacccngccaccncagccncacaccaaggagggcgnngangccnacaacgaagngancgcccgggngcgaangngggngaaccngaaccngnggcagaagcngaagcnaagcagagangangccaagccncngcngagacngaaggganncccnnccnnnccncnggncgagagacaggccaacgaagnggacnggngggacanggngngnaacgngaagaagcngancaacgagaaaaaggagganggcaaggngnnnnggcagaancnggcnggcnacaagagacaggaagcccngagaccanaccngagcagcgaggaagancggaagaagggaaagaaanncgcncggnaccagcngggcgaccngcngcngcaccnggaaaagaagcacggcgaggacnggggaaaggngnacgacgaggccngggagcgganngacaagaaagnggaaggccngagcaagcacancaagcnggaagaggaacggagaagcgaggacgcccagagcaaggccgcccngaccgacnggcngcgggcnaaggccagcnncgngancgagggccngaaggaggccgacaaggacgagnncngcagangcgagcngaagcngcagaagnggnacggggaccngcggggaaagcccnncgccancgaagccgagaacagcanccnggacancagcggcnncagcaagcagnacaacngngccnncancnggcagaaggacggcgngaagaagcngaaccngnaccngancancaacnacnncaagggcggcaagcngcggnncaagaagancaaaccngaagccnncgaagccaacaganncnacaccgngancaacaaaaagagcggcgagancgngcccanggaggngaacnncaacnncgacgaccccaaccngancanccngccncnggccnnnggcaagagacagggcagagaanncancnggaacgaccngcngncccnggaaaccggcagccngaagcnggccaacggaagagngancgagaagacacngnacaacagaagaacccggcaggangagccngcccngnncgnggcccngaccnncgagcggcgggaggnccnggacnccnccaanancaaaccaangaaccngancggcgnggcaagaggcgaaaacanccccgccgngancgcccngaccgaccccgagggcngcccacngagccggnnnaagganagccngggaaacccaacccacanccngagaancggcgagagcnanaaggagaagcagcggaccanccaggccaagaaggaggnggagcagcggagagccggcggcnacagccggaagnacgccagcaaagccaagaancnggcagacgananggngagaaacaccgcnagagancngcngnacnacgccgngacccaggangccangcngancnncgccaaccngagccggggcnncggccggcagggcaagcggaccnncanggccgagagacagnacacacgganggaggacnggcngaccgccaagcnggccnacgagggccngagcaagaccnaccngnccaagacacnggcccagnacaccnccaagacangcagcaacngngggnnnaccancaccagcgccgacnacgacagggngcnggagaagcngaagaagacagcaacaggcnggangaccacaannaacggcaaggagcngaaggnggagggccagannaccnacnacaacaganacaagagacagaacgnagncaaggaccngnccgncgagcngganagacngagcgaagaancngngaacaacgacancnccnccnggacaaagggcagaagcggagaagcncngagccnccngaagaaaaganncncccanagacccgngcaggagaagnncgngngccngaacngcggcnncgagacacacgcagccgagcaagccgcccngaacancgccaganccnggcngnnccngcggagccaggagnacaagaaanaccagacaaacaagacaaccggcaacaccganaagagagccnncgncgagaccnggcagnccnnnnaccggaagaagcnnaaggaggngnggaaaccngccgngcggncnggcggancnggcggaggcnccacaagcangaacaacncccagggcagagngaccnncgaggacgngaccgngaannnnacacagggagagnggcagagacngaaccccgagcagagaaaccngnaccgggangngangcnggaaaacnacagcaancnggngnccgngggccagggcgagaccacaaagccngacgnganccngcgncnggagcagggcaaggaacccnggcnggaggaggaggaggngcngggaagcggacgggccgagaagaacggcgacancggcggacagancnggaagccnaaggacgngaaagaaagccngggcncncccgccgccaagagagngaagcnggacnaanaganaagcggccgcnnaannaagcngccnncngcggggcnngccnncnggccangcccnncnncncncccnngcaccngnaccncnnggncnnngaanaaagccngagnaggaagncnagaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59623 - RNA, 5439 nt, synthetic construct
  source 1..5439: mol_type = other RNA
  modified_base 1..5439: mod_base = m1f
aaanaagagagaaaagaagagnaagaagaaananaagagccaccanggccccnaagaagaagcgnaaagngagccggangaaccacgaccaggagnncgaccccccnaaggngnacccncccgnccccgccgagaagagaaagcccanccgggnccngagccngnncganggcancgccaccggncngcnggngcngaaggaccngggcanccaggngganaggnacanngccnccgaggngngcgaggacnccancaccgngggaanggngcgncancagggcaagancangnacgngggcgacgngcggagcgngacacagaagcananccaggagnggggcccnnncgaccnggngancggcggcagcccnngcaangaccngagcancgngaacccagcccggaagggccngnacgagggaaccggcagacngnncnncgagnnnnacagacngcngcacgacgcccggccnaaggaaggcgacgaccggcccnncnnnnggcngnncgagaangnggnggccangggagncagcgacaagcggganannagccggnnccnggagagcaaccccgngangancgangccaaggaagngagcgccgcccaccgggccaganacnncnggggcaancngccnggcangaacagaccccnggccagcaccgngaacgacaagcnggagcngcaggagngccnggagcacggccggancgccaagnncagcaaggngagaaccancaccacccgaagcaacagcancaaacaaggcaaggaccagcacnnnccngngnncangaacgagaaggaggacanccngnggngnaccgaganggagagagngnncgggnncccagnccacnacacagangncagcaacangncnagacnggccagacagagacngcngggaagaagcnggnccgncccngngancagacaccngnncgccccncngaaggagnacnncgccngcgngagcagcggcaacagcaacgccaacagccggggccccagcnncncnagcggccnggngccacngncccngagagggagccacangggccccanggagancnacaaaaccgngagcgccnggaagcggcagccngngcgcgngcngagccngnnncggaanancganaaagnccngaaaagccngggannccnggagagcggcncnggcnccggcggnggcacccngaagnacgnggaggangngacaaacgnggncagacgggangnggagaagnggggccccnncgancnggngnacggcagcacccaaccccngggcagcncnngngaccggngcccnggcnggnacangnnncagnnccaccgganccngcagnacgcccngccgagacaggagncccagcggccanncnnnnggannnncanggacaacnngcngcngaccgaggangaccaggaaacnaccacncggnnccngcagaccgaagccgngacccngcaggacgngagaggccgggacnaccagaacgccangcgggngnggnccaacancccnggacngaaaagcaagcacgcaccncngaccccnaaagaagaggagnaccngcaggcccaggngcggagcagaagcaagcnggacgccccnaaggnggancngcnggngaagaanngccnccngccccngagagagnacnncaagnannncagccagaanagncngccccngggaggcagcggcggcggcangaacaacncccagggcagagngaccnncgaggacgngaccgngaannnnacacagggagagnggcagagacngaaccccgagcagagaaaccngnaccgggangngangcnggaaaacnacagcaancnggngnccgngggccagggcgagaccacaaagccngacgnganccngcgncnggagcagggcaaggaacccnggcnggaggaggaggaggngcngggaagcggacgggccgagaagaacggcgacancggcggacagancnggaagccnaaggacgngaaagaaagccngggcggcccaagcagcggcgccccnccncccagcggcggcagcccagccggcnccccaaccncnaccgaggagggcaccncngagnccgccacccccgagagcggcccnggcaccnccaccgagcccagcgagggcagcgcacccggcagcccngccggcagccccaccnccacagaggagggaaccagcaccgagcccagcgaaggcagcgccccaggcaccagcaccgagccnagngagcaggagannaaacggancaacaagancagaagaagacnngngaaagacagcaacaccaagaaggccggcaagacaggccccangaaaacccngcnggnnagagngangacacccgancngagagagcggcnggaaaaccngagaaagaagccngaaaanancccccagcccancagcaanacancnagagccaaccngaanaagcngcngaccgannacaccgaaangaagaaggcganccngcangngnacngggaagagnnccagaaggacccngngggccngangagccgggnggcccagccngccagcaagaagancgancagaacaagcngaaaccngaganggacgagaagggcaaccngaccaccgccggcnnngccngcncncagngnggccagccccngnncgngnacaagcnggagcaggngncngagaagggcaaggcnnacaccaacnacnncggacggngcaangnggccgagcacgaaaagcnganccngcnggcccagcngaagcccgagaagganagcgacgaagccgngacananagccngggaaagnnngggcagagggcccnggannncnacagcanncangngaccaaggagnccacccaccccgngaagccccnggcccagancgccggaaacaganacgccnccggaccngngggaaaggcccngagcgacgcangnangggcacaancgccnccnnccngncnaagnaccaggacancancancgaacaccagaaggnggngaagggcaaccagaagagacnggagagccngcgggagcnggccggcaaggaaaaccnggaanacccnagcgngacccngccaccncagccncacaccaaggagggcgnngangccnacaacgaagngancgcccgggngcgaangngggngaaccngaaccngnggcagaagcngaagcnaagcagagangangccaagccncngcngagacngaaggganncccnnccnnnccncnggncgagagacaggccaacgaagnggacnggngggacanggngngnaacgngaagaagcngancaacgagaaaaaggagganggcaaggngnnnnggcagaancnggcnggcnacaagagacaggaagcccngagaccanaccngagcagcgaggaagancggaagaagggaaagaaanncgcncggnaccagcngggcgaccngcngcngcaccnggaaaagaagcacggcgaggacnggggaaaggngnacgacgaggccngggagcgganngacaagaaagnggaaggccngagcaagcacancaagcnggaagaggaacggagaagcgaggacgcccagagcaaggccgcccngaccgacnggcngcgggcnaaggccagcnncgngancgagggccngaaggaggccgacaaggacgagnncngcagangcgagcngaagcngcagaagnggnacggggaccngcggggaaagcccnncgccancgaagccgagaacagcanccnggacancagcggcnncagcaagcagnacaacngngccnncancnggcagaaggacggcgngaagaagcngaaccngnaccngancancaacnacnncaagggcggcaagcngcggnncaagaagancaaaccngaagccnncgaagccaacaganncnacaccgngancaacaaaaagagcggcgagancgngcccanggaggngaacnncaacnncgacgaccccaaccngancanccngccncnggccnnnggcaagagacagggcagagaanncancnggaacgaccngcngncccnggaaaccggcagccngaagcnggccaacggaagagngancgagaagacacngnacaacagaagaacccggcaggangagccngcccngnncgnggcccngaccnncgagcggcgggaggnccnggacnccnccaanancaaaccaangaaccngancggcgnggcaagaggcgaaaacanccccgccgngancgcccngaccgaccccgagggcngcccacngagccggnnnaagganagccngggaaacccaacccacanccngagaancggcgagagcnanaaggagaagcagcggaccanccaggccaagaaggaggnggagcagcggagagccggcggcnacagccggaagnacgccagcaaagccaagaancnggcagacgananggngagaaacaccgcnagagancngcngnacnacgccgngacccaggangccangcngancnncgccaaccngagccggggcnncggccggcagggcaagcggaccnncanggccgagagacagnacacacgganggaggacnggcngaccgccaagcnggccnacgagggccngagcaagaccnaccngnccaagacacnggcccagnacaccnccaagacangcagcaacngngggnnnaccancaccagcgccgacnacgacagggngcnggagaagcngaagaagacagcaacaggcnggangaccacaannaacggcaaggagcngaaggnggagggccagannaccnacnacaacaganacaagagacagaacgnagncaaggaccngnccgncgagcngganagacngagcgaagaancngngaacaacgacancnccnccnggacaaagggcagaagcggagaagcncngagccnccngaagaaaaganncncccanagacccgngcaggagaagnncgngngccngaacngcggcnncgagacacacgcagccgagcaagccgcccngaacancgccaganccnggcngnnccngcggagccaggagnacaagaaanaccagacaaacaagacaaccggcaacaccganaagagagccnncgncgagaccnggcagnccnnnnaccggaagaagcnnaaggaggngnggaaaccngccgngcggncnggcggancnggcggaggcnccaccagccccaagaaaaagagaaaagncnaanaganaagcngccnncngcggggcnngccnncnggccangcccnncnncncncccnngcaccngnaccncnnggncnnngaanaaagccngagnaggaagncnagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59624 - RNA, 5844 nt, synthetic construct
  source 1..5844: mol_type = other RNA
  modified_base 1..5844: mod_base = m1f
aaanaagagagaaaagaagagnaagaagaaananaagagccaccanggccccnaagaagaagcgnaaagngagccgganggaacgccncgncnacgaggngcggcagaagngcagaaacancgaggacancngcancnccngcggancncngaacgngacccnggagcacccacngnncancggcggcangngccagaacngnaaaaacngnnnncnggagngngccnancaanacgacgangacggcnaccagagcnacngcaccancngnngcggcggaagagaggngcngangngnggaaanaacaacngcngccggngcnncngcgnggaangcgnggaccngcnggngggccccggcgccgcccaggccgcnannaaggaaganccnnggaacngcnacangngcggccacaagggcacanacggccngcngagacggagagaggacnggccnagcagacngcagangnncnncgccaanaaccacgaccaggagnncgaccccccnaaggngnacccncccgnccccgccgagaagagaaagcccanccgggnccngagccngnncganggcancgccaccggncngcnggngcngaaggaccngggcanccaggngganaggnacanngccnccgaggngngcgaggacnccancaccgngggaanggngcgncancagggcaagancangnacgngggcgacgngcggagcgngacacagaagcananccaggagnggggcccnnncgaccnggngancggcggcagcccnngcaangaccngagcancgngaacccagcccggaagggccngnacgagggaaccggcagacngnncnncgagnnnnacagacngcngcacgacgcccggccnaaggaaggcgacgaccggcccnncnnnnggcngnncgagaangnggnggccangggagncagcgacaagcggganannagccggnnccnggagagcaaccccgngangancgangccaaggaagngagcgccgcccaccgggccaganacnncnggggcaancngccnggcangaacagaccccnggccagcaccgngaacgacaagcnggagcngcaggagngccnggagcacggccggancgccaagnncagcaaggngagaaccancaccacccgaagcaacagcancaaacaaggcaaggaccagcacnnnccngngnncangaacgagaaggaggacanccngnggngnaccgaganggagagagngnncgggnncccagnccacnacacagangncagcaacangncnagacnggccagacagagacngcngggaagaagcnggnccgncccngngancagacaccngnncgccccncngaaggagnacnncgccngcgngagcagcggcaacagcaacgccaacagccggggccccagcnncncnagcggccnggngccacngncccngagagggagccacangggccccanggagancnacaaaaccgngagcgccnggaagcggcagccngngcgcgngcngagccngnnncggaanancganaaagnccngaaaagccngggannccnggagagcggcncnggcnccggcggnggcacccngaagnacgnggaggangngacaaacgnggncagacgggangnggagaagnggggccccnncgancnggngnacggcagcacccaaccccngggcagcncnngngaccggngcccnggcnggnacangnnncagnnccaccgganccngcagnacgcccngccgagacaggagncccagcggccanncnnnnggannnncanggacaacnngcngcngaccgaggangaccaggaaacnaccacncggnnccngcagaccgaagccgngacccngcaggacgngagaggccgggacnaccagaacgccangcgggngnggnccaacancccnggacngaaaagcaagcacgcaccncngaccccnaaagaagaggagnaccngcaggcccaggngcggagcagaagcaagcnggacgccccnaaggnggancngcnggngaagaanngccnccngccccngagagagnacnncaagnannncagccagaanagncngccccngggaggcagcggcggcggcangaacaacncccagggcagagngaccnncgaggacgngaccgngaannnnacacagggagagnggcagagacngaaccccgagcagagaaaccngnaccgggangngangcnggaaaacnacagcaancnggngnccgngggccagggcgagaccacaaagccngacgnganccngcgncnggagcagggcaaggaacccnggcnggaggaggaggaggngcngggaagcggacgggccgagaagaacggcgacancggcggacagancnggaagccnaaggacgngaaagaaagccngggcggcccaagcagcggcgccccnccncccagcggcggcagcccagccggcnccccaaccncnaccgaggagggcaccncngagnccgccacccccgagagcggcccnggcaccnccaccgagcccagcgagggcagcgcacccggcagcccngccggcagccccaccnccacagaggagggaaccagcaccgagcccagcgaaggcagcgccccaggcaccagcaccgagccnagngagcaggagannaaacggancaacaagancagaagaagacnngngaaagacagcaacaccaagaaggccggcaagacaggccccangaaaacccngcnggnnagagngangacacccgancngagagagcggcnggaaaaccngagaaagaagccngaaaanancccccagcccancagcaanacancnagagccaaccngaanaagcngcngaccgannacaccgaaangaagaaggcganccngcangngnacngggaagagnnccagaaggacccngngggccngangagccgggnggcccagccngccagcaagaagancgancagaacaagcngaaaccngaganggacgagaagggcaaccngaccaccgccggcnnngccngcncncagngnggccagccccngnncgngnacaagcnggagcaggngncngagaagggcaaggcnnacaccaacnacnncggacggngcaangnggccgagcacgaaaagcnganccngcnggcccagcngaagcccgagaagganagcgacgaagccgngacananagccngggaaagnnngggcagagggcccnggannncnacagcanncangngaccaaggagnccacccaccccgngaagccccnggcccagancgccggaaacaganacgccnccggaccngngggaaaggcccngagcgacgcangnangggcacaancgccnccnnccngncnaagnaccaggacancancancgaacaccagaaggnggngaagggcaaccagaagagacnggagagccngcgggagcnggccggcaaggaaaaccnggaanacccnagcgngacccngccaccncagccncacaccaaggagggcgnngangccnacaacgaagngancgcccgggngcgaangngggngaaccngaaccngnggcagaagcngaagcnaagcagagangangccaagccncngcngagacngaaggganncccnnccnnnccncnggncgagagacaggccaacgaagnggacnggngggacanggngngnaacgngaagaagcngancaacgagaaaaaggagganggcaaggngnnnnggcagaancnggcnggcnacaagagacaggaagcccngagaccanaccngagcagcgaggaagancggaagaagggaaagaaanncgcncggnaccagcngggcgaccngcngcngcaccnggaaaagaagcacggcgaggacnggggaaaggngnacgacgaggccngggagcgganngacaagaaagnggaaggccngagcaagcacancaagcnggaagaggaacggagaagcgaggacgcccagagcaaggccgcccngaccgacnggcngcgggcnaaggccagcnncgngancgagggccngaaggaggccgacaaggacgagnncngcagangcgagcngaagcngcagaagnggnacggggaccngcggggaaagcccnncgccancgaagccgagaacagcanccnggacancagcggcnncagcaagcagnacaacngngccnncancnggcagaaggacggcgngaagaagcngaaccngnaccngancancaacnacnncaagggcggcaagcngcggnncaagaagancaaaccngaagccnncgaagccaacaganncnacaccgngancaacaaaaagagcggcgagancgngcccanggaggngaacnncaacnncgacgaccccaaccngancanccngccncnggccnnnggcaagagacagggcagagaanncancnggaacgaccngcngncccnggaaaccggcagccngaagcnggccaacggaagagngancgagaagacacngnacaacagaagaacccggcaggangagccngcccngnncgnggcccngaccnncgagcggcgggaggnccnggacnccnccaanancaaaccaangaaccngancggcgnggcaagaggcgaaaacanccccgccgngancgcccngaccgaccccgagggcngcccacngagccggnnnaagganagccngggaaacccaacccacanccngagaancggcgagagcnanaaggagaagcagcggaccanccaggccaagaaggaggnggagcagcggagagccggcggcnacagccggaagnacgccagcaaagccaagaancnggcagacgananggngagaaacaccgcnagagancngcngnacnacgccgngacccaggangccangcngancnncgccaaccngagccggggcnncggccggcagggcaagcggaccnncanggccgagagacagnacacacgganggaggacnggcngaccgccaagcnggccnacgagggccngagcaagaccnaccngnccaagacacnggcccagnacaccnccaagacangcagcaacngngggnnnaccancaccagcgccgacnacgacagggngcnggagaagcngaagaagacagcaacaggcnggangaccacaannaacggcaaggagcngaaggnggagggccagannaccnacnacaacaganacaagagacagaacgnagncaaggaccngnccgncgagcngganagacngagcgaagaancngngaacaacgacancnccnccnggacaaagggcagaagcggagaagcncngagccnccngaagaaaaganncncccanagacccgngcaggagaagnncgngngccngaacngcggcnncgagacacacgcagccgagcaagccgcccngaacancgccaganccnggcngnnccngcggagccaggagnacaagaaanaccagacaaacaagacaaccggcaacaccganaagagagccnncgncgagaccnggcagnccnnnnaccggaagaagcnnaaggaggngnggaaaccngccgngcggncnggcggancnggcggaggcnccaccagccccaagaaaaagagaaaagncnaanaganaagcngccnncngcggggcnngccnncnggccangcccnncnncncncccnngcaccngnaccncnnggncnnngaanaaagccngagnaggaagncnagaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 59625 - protein, 214 aa, synthetic construct
GPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPL

SEQ ID NO: 59626 - protein, 71 aa, synthetic construct
DAKSLTAWSRTLVTFKDVFVDFTREEWKLLDTAQQIVYRNVMLENYKNLVSLGYQLTKPDVILRLEKGEEP

SEQ ID NO: 59627 - protein, 99 aa, synthetic construct
NNSQGRVTFEDVTVNFTQGEWQRLNPEQRNLYRDVMLENYSNLVSVGQGETTKPDVILRLEQGKEPWLEEEEVLGSGRAEKNGDIGGQIWKPKDVKESL

SEQ ID NO: 59628 - RNA, 20 nt, synthetic construct
  source 1..20: mol_type = other RNA
ggccgagatgtctcgctccg

SEQ ID NO: 59629 - RNA, 20 nt, synthetic construct
  source 1..20: mol_type = other RNA
cgcgagcacagctaaggcca

SEQ ID NO: 59630 - RNA, 20 nt, synthetic construct
  source 1..20: mol_type = other RNA
cgagacgtaattacgtctcg

SEQ ID NO: 59631 - RNA, 20 nt, synthetic construct
  source 1..20: mol_type = other RNA
actgggaggctcagcccatg

SEQ ID NO: 59632 - RNA, 20 nt, synthetic construct
  source 1..20: mol_type = other RNA
tgttctgtcttgaactagct

SEQ ID NO: 59633 - RNA, 20 nt, synthetic construct
  source 1..20: mol_type = other RNA
tgagtgtcttgtcttgctca

SEQ ID NO: 59634 - RNA, 20 nt, synthetic construct
  source 1..20: mol_type = other RNA
ggaatgcccgccagcgcgac

SEQ ID NO: 59635 - RNA, 20 nt, synthetic construct
  source 1..20: mol_type = other RNA
cgctgcggtctgtgggcgtg

SEQ ID NO: 59636 - RNA, 20 nt, synthetic construct
  source 1..20: mol_type = other RNA
gtgtgccatggacgggtaag

SEQ ID NO: 59637 - RNA, 20 nt, synthetic construct
  source 1..20: mol_type = other RNA
cagcggggatccgacgagct

SEQ ID NO: 59638 - RNA, 20 nt, synthetic construct
  source 1..20: mol_type = other RNA
ccacgtgtgtcagcaacggc

SEQ ID NO: 59639 - RNA, 20 nt, synthetic construct
  source 1..20: mol_type = other RNA
acagcatcgtcccagacata

SEQ ID NO: 59640 - DNA, 20 bp, synthetic construct
  source 1..20: mol_type = other DNA
cagcgctgggagccgccgcc

SEQ ID NO: 59641 - DNA, 20 bp, synthetic construct
  source 1..20: mol_type = other DNA
gcccaggggtcccgggacgc

SEQ ID NO: 59642 - DNA, 20 bp, synthetic construct
  source 1..20: mol_type = other DNA
ctccgcccgcagcagccccc

SEQ ID NO: 59643 - DNA, 20 bp, synthetic construct
  source 1..20: mol_type = other DNA
gacctgccgagcgcccgccg

SEQ ID NO: 59644 - DNA, 19 bp, synthetic construct
  source 1..19: mol_type = other DNA
accacgcgtccgagtccgg

SEQ ID NO: 59645 - DNA, 19 bp, synthetic construct
  source 1..19: mol_type = other DNA
tgctcattgtccctggaca

SEQ ID NO: 59646 - DNA, 19 bp, synthetic construct
  source 1..19: mol_type = other DNA
ggacaccctgctcattgtc

SEQ ID NO: 59647 - RNA, 20 nt, synthetic construct
  source 1..20: mol_type = other RNA
cagcgctgggagccgccgcc

SEQ ID NO: 59648 - RNA, 20 nt, synthetic construct
  source 1..20: mol_type = other RNA
gcccaggggtcccgggacgc

SEQ ID NO: 59649 - RNA, 20 nt, synthetic construct
  source 1..20: mol_type = other RNA
ctccgcccgcagcagccccc

SEQ ID NO: 59650 - RNA, 20 nt, synthetic construct
  source 1..20: mol_type = other RNA
gacctgccgagcgcccgccg

SEQ ID NO: 59651 - RNA, 19 nt, synthetic construct
  source 1..19: mol_type = other RNA
accacgcgtccgagtccgg

SEQ ID NO: 59652 - RNA, 19 nt, synthetic construct
  source 1..19: mol_type = other RNA
tgctcattgtccctggaca

SEQ ID NO: 59653 - RNA, 19 nt, synthetic construct
  source 1..19: mol_type = other RNA
ggacaccctgctcattgtc

SEQ ID NO: 59654 - DNA, 20 bp, synthetic construct
  source 1..20: mol_type = other DNA
taaacatcacgagactctaa

SEQ ID NO: 59655 - DNA, 20 bp, synthetic construct
  source 1..20: mol_type = other DNA
aggacttcaggctggaggca

SEQ ID NO: 59656 - DNA, 20 bp, synthetic construct
  source 1..20: mol_type = other DNA
cgaatgaaaaatgcaggtcc

SEQ ID NO: 59657 - DNA, 20 bp, synthetic construct
  source 1..20: mol_type = other DNA
gtttataactacagcttggg

SEQ ID NO: 59658 - DNA, 20 bp, synthetic construct
  source 1..20: mol_type = other DNA
ctgagctgtcctcaggatgc

SEQ ID NO: 59659 - DNA, 20 bp, synthetic construct
  source 1..20: mol_type = other DNA
tccctatgtccttgctgttt

SEQ ID NO: 59660 - DNA, 20 bp, synthetic construct
  source 1..20: mol_type = other DNA
agcgccctctaggtacatca

SEQ ID NO: 59661 - DNA, 20 bp, synthetic construct
  source 1..20: mol_type = other DNA
gtttactgagtacctactat

SEQ ID NO: 59662 - RNA, 20 nt, synthetic construct
  source 1..20: mol_type = other RNA
taaacatcacgagactctaa

SEQ ID NO: 59663 - RNA, 20 nt, synthetic construct
  source 1..20: mol_type = other RNA
aggacttcaggctggaggca

SEQ ID NO: 59664 - RNA, 20 nt, synthetic construct
  source 1..20: mol_type = other RNA
cgaatgaaaaatgcaggtcc

SEQ ID NO: 59665 - RNA, 20 nt, synthetic construct
  source 1..20: mol_type = other RNA
gtttataactacagcttggg

SEQ ID NO: 59666 - RNA, 20 nt, synthetic construct
  source 1..20: mol_type = other RNA
ctgagctgtcctcaggatgc

SEQ ID NO: 59667 - RNA, 20 nt, synthetic construct
  source 1..20: mol_type = other RNA
tccctatgtccttgctgttt

SEQ ID NO: 59668 - RNA, 20 nt, synthetic construct
  source 1..20: mol_type = other RNA
agcgccctctaggtacatca

SEQ ID NO: 59669 - RNA, 20 nt, synthetic construct
  source 1..20: mol_type = other RNA
gtttactgagtacctactat

SEQ ID NO: 59670 - RNA, 20 nt, synthetic construct
  source 1..20: mol_type = other RNA
cgtaacctacggtgtcccgc

SEQ ID NO: 59671 - RNA, 20 nt, synthetic construct
  source 1..20: mol_type = other RNA
tagcgggacaccgtaggtta

SEQ ID NO: 59672 - RNA, 20 nt, synthetic construct
  source 1..20: mol_type = other RNA
cttttgggggcggggtctag

SEQ ID NO: 59673 - protein, 1719 aa, synthetic construct
MAPKKKRKVSRMMFQDSVAFEDVAVTFTQEEWALLDPSQKNLYRDVMQETFRNLASIGKKWKPQNIYVEYENLRRNLRIVGERLFESKEGHQGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59674 - protein, 1719 aa, synthetic construct
MAPKKKRKVSRQDPSAEGLSEEVPVVFEELPVVFEDVAVYFTREEWGMLDKRQKELYRDVMRMNYELLASLGPAAAKPDLISKLERRAAPWIGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59675 - protein, 1719 aa, synthetic construct
MAPKKKRKVSRMIQAQESITLEDVAVDFTWEEWQLLGAAQKDLYRDVMLENYSNLVAVGYQASKPDALFKLEQGEQPWTTEDGIHSGACSDMGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59676 - protein, 1719 aa, synthetic construct
MAPKKKRKVSRMDSVAFEDVAVNFTQEEWALLDPSQKNLYREVMQETVRNLASIGKKWNNQYIEDEHQNPRKNLRRLIGERLSESKESHQHGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59677 - protein, 1719 aa, synthetic construct
MAPKKKRKVSRMPGPPGSLEMDPLTFRDVAIEFSLEEWQCLDTAQQNLYRNVMLENYKNLAFLGIAVSKPDLITRLEKEKEPWKMKRHRMVDGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59678 - protein, 1719 aa, synthetic construct
MAPKKKRKVSREAVTFKDVAVFFTEEELGLLDLAQRKLYRDVMLENFRNLLSVGHQPFHQDVFHFLREEKFWMMETATQREGNSGENASVHPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59679 - protein, 1719 aa, synthetic construct
MAPKKKRKVSRRALTPVSMTAEAKCTGFTQGSVTFEDVAIYFSQEEWGLLDEAQRLLYRDVMLENFALLTSLVCWHGMEDEETPEQSVSVNGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59680 - protein, 1719 aa, synthetic construct
MAPKKKRKVSRQDPSAERLMEEVPVVFEELPVVFEDVAVYFTREEWGMLDKRQKELYRDVMRMNYELLASLGPAAAKPDLISKLERRAAPWIGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59681 - protein, 1719 aa, synthetic construct
MAPKKKRKVSRLAPEDHGSSYEGSVSFRDVAIDFSREEWRHLDLSQRNLYRDVMLETYSHLLSVGYQVPEAEVVMLEQGNEPWSLQGERPHQGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59682 - protein, 1719 aa, synthetic construct
MAPKKKRKVSRMAAAALRLPAQGTVTFEDVAVKFSQEEWSLLSEAQRCLYHDVMLENLALISSLGCWYGANDETPSKQTLSIQQQSPLRSHWGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59683 - protein, 1719 aa, synthetic construct
MAPKKKRKVSRSVTFEDVAVNFSLEEWNLLNEAQRCLYRDVMLETLTLISSLGAPPHTLFPARACGPEAPPSRHCPRPSLCLSLSPLHPTGVGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59684 - protein, 1719 aa, synthetic construct
MAPKKKRKVSRMELREAFEDVAVYFTRKEWELLEDEDKELYRDLMLRNYQALVSLGYQGPTPGLICRIKQREVELWVCDDEHHGESSVSENLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59685 - protein, 1719 aa, synthetic construct
MAPKKKRKVSRQGSVSFEDVAVYFTEEEWALLDSSQRALHREVMLENSRNLAAVGYGQEHKNYQEPSLALFQSEERMLGIQRVLQKTRRSCLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59686 - protein, 1719 aa, synthetic construct
MAPKKKRKVSRLVKFEEVAVVFSEDEWNLLSDQQRGLYMEVMKENYEHLIYLGYEVPVILSLLQDGGGISSDAGSQSKSQQVAVAEGSNVNSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59687 - protein, 1719 aa, synthetic construct
MAPKKKRKVSRTQVPVTFEDVAVYFCEGEWETLAEWQKELYRETMKENYETLTSLGFSSKKPSLISKIEREEDPCVRDKQDSRDRRRLRSCWGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59688 - protein, 1719 aa, synthetic construct
MAPKKKRKVSRQDVVTFKDVAIYFSPEEWVRLSAGQRELYQEVMLDNYELVTSLDRESKLLYKMDPEEESCEGVPYSSADSGAPDSSSTSACGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59689 - protein, 1719 aa, synthetic construct
MAPKKKRKVSRSQCLLTFGDVSVDFSQEEWECLDSAQRALYIDVMLENYSNLVSVENYSTCDTVHQHVNTGKESCQRNNLGEMLRNPSHDALGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59690 - protein, 1719 aa, synthetic construct
MAPKKKRKVSRNEMVTFKDVAVVFSGEELELLDSAQWKLYQDVMLENFRNLLSVGGRIQTELETFPEAGPHEELSWQQIWEQIASDSTFSQDGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59691 - protein, 1719 aa, synthetic construct
MAPKKKRKVSRARVAVMFSDVSIAFSQEEWEYLDLAQRDLYKDVMMENYRNVASLAGCFISKPDVISLLEQGKEPWKVVRKRRRNPDLETKDGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59692 - protein, 1719 aa, synthetic construct
MAPKKKRKVSRPQSLLSFGDVAVDFSQEEWEYLDYDQRTLYMDVMLENYSNLVFVENHRIYGKYEKDLDQGTKHIAHEDVIIQEKSYKCNELGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59693 - protein, 1719 aa, synthetic construct
MAPKKKRKVSRIQNTVTYDDVHIDFTWEEWTLLDPSQRNLYKDVMVETYTNLTAVGYSWEDHNMEEHCQSSQRQRRYKRSNTGEKPCEYTQCGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59694 - protein, 1719 aa, synthetic construct
MAPKKKRKVSRMNAVTYEDVHVNFTQEEWALLDPSQKKLYKDVMLETYRNLNAIGFNWDSKIFKNIVQVLEDTEGMKEVRVQRKRLNILNVIGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59695 - protein, 1719 aa, synthetic construct
MAPKKKRKVSRAVTMEDVTVTFTNEEWALLNPAQKRLYGDVMWETFRTISAIGRTWDSQQMEEEYKNYLRNLSNEEVAKCCRYTTFNQHENIGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59696 - protein, 1719 aa, synthetic construct
MAPKKKRKVSRALVTFEDVAVRFTQEEWALLDPSQKILYRDVMRETYRNLTSVGINWECWDLEACFRSLGRNLRVQVVKRKCELTNSGPCAEGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59697 - protein, 1719 aa, synthetic construct
MAPKKKRKVSRSNKLVSFDDVAVEFSWEEWQELDISQRTLYRDVMLETYSMLVSLGHTGPKPQLIVKLEQDEESYMREASDKNFSDVQKMKHGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59698 - protein, 1719 aa, synthetic construct
MAPKKKRKVSRKPGAVSFADVAVYFSPEEWGCLRPAQRALYRDVMRETYGHLGALGFPGPKPALISWMEQESEAWSPAAQDPEKGERLGGARGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59699 - protein, 1719 aa, synthetic construct
MAPKKKRKVSRFQEPLKFRDVAVEFSLEEWQCLDTIQQNLYRNVMLENYRNLVFLGIAVSKPDLITCLEQEKEPWTRKRHRMVAKPVTCSHFGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59700 - protein, 1719 aa, synthetic construct
MAPKKKRKVSRSQGRLRFQDVAIDFTLEEWECLDLGQRELYRDVMLENYGNLASLGLIVCKPDLVTFLEKMRDPQDVRGIETTAIHPDLASFGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59701 - protein, 1719 aa, synthetic construct
MAPKKKRKVSRSQSPLTFGDVAVEFSGEEWAWLDSAQRSLHRSVMLENYRNLASLGLCLSKPEMISSLEQRKEPWAVKRKSTRGMRPDSQTLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59702 - protein, 1719 aa, synthetic construct
MAPKKKRKVSRRAEEAVTFKDVAVVFTEEELQLLDLAQRKLYRDVMLENFRNLLSVGHQPFHGDTFHFLREEKFWVMETTSQREGNSGGKIQGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59703 - protein, 1719 aa, synthetic construct
MAPKKKRKVSRFQAPVTFGDLAIYFSQEEWECLSPIQKDLYEDVMLENYQNLVSLGLSFRRPNVITLLEKGKAPWMVEPVKRRRGLDLGSKCGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59704 - protein, 1719 aa, synthetic construct
MAPKKKRKVSRSQGPVSFEDVAVDFTQEEWQQLDPAQRTLYRDVMLENYSHLVSVGYPVSKPGVISKLEQGEEPWIMKRDISNWIYPDRETRGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59705 - protein, 1719 aa, synthetic construct
MAPKKKRKVSRSQESVAFEDVAVYFTTKEWAIMVPAERALYRDVMLENYEAVAFVVPPTSKPALVSHLEQGKESCFIRPQGVLSRSDWRAGLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59706 - protein, 1719 aa, synthetic construct
MAPKKKRKVSRFQGSISFKDVTVGFTQEEWQHLDPSQRALYRDVMLENYSNLVSVGYCVHKPEVISRLEQGEEPWRLEEEFPSQSFPVWTADGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59707 - protein, 1719 aa, synthetic construct
MAPKKKRKVSRPQESVTFKDVAVDFTWEEWGYLDTSQKELYQEVMLENYRNLVSLGFVVAKPDVISQLEQGEAPWRPEGRFPRSRHPDSDTRGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59708 - protein, 1719 aa, synthetic construct
MAPKKKRKVSRCYQDSVTFDDVAVDFTQEEWTLLDSTQRSLYSDVMLENYKNLATVGGQIIKPSLISWLEQEESRTVQGGVLRGRKTQWRGTGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59709 - protein, 1719 aa, synthetic construct
MAPKKKRKVSRPQESVTFKDIAVDFTQEEWALLDASQRKLYRDVMLENIGHLVSVGYRVCKSDVISQLQQGVELWREGRGFPQGVIPDRKSSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59710 - protein, 1719 aa, synthetic construct
MAPKKKRKVSRMGQLTFNDVTIEFSLEEWQCLDKPQQNLYREVMLENYRNLVFLGIAVSKPDLITCLKQGKEPWNIRRHEMVTKPPAMCSHFGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59711 - protein, 1719 aa, synthetic construct
MAPKKKRKVSRVWGPLSFMDVFVDFTWEEWQLLDPAQKCLYRSVMLENYSNLVSLGYQHTKPDIIFKLEQGEELCMVQAPIPNQCCPNKVWKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59712 - protein, 1719 aa, synthetic construct
MAPKKKRKVSRSKAPITFGDLAIYFSQEEWEWLSPIQKDLYEDVMLENYRNLVSLGLSFRRPNVITLLEKGKAPWMVEPARRRRGPDSGSKVGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59713 - protein, 1719 aa, synthetic construct
MAPKKKRKVSRFQASVVFEDVAVNFTPEEWALLNRGQRKLYRDVMLETCRNLSAVGKDGSIPSLVFSEKQKFHSSGDLTRMQEGLLRSPLVEGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59714 - protein, 1719 aa, synthetic construct
MAPKKKRKVSRSQEQVSFKDVCVDFTREEWYLLDPAQKILYRDVILENYSHLVSVGNCITKPEVIFKIEQGEEPWILEERFPKQCCSERNWKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59715 - protein, 1719 aa, synthetic construct
MAPKKKRKVSRMVSFEDVAVLLSQEEWDCLIPAQRGLYRDVMLETYGNLVSLGLQASKPDVISRLEQGDEPWTTHTLRMQGSWSWRHKREGCGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59716 - protein, 1719 aa, synthetic construct
MAPKKKRKVSRSQASVSFKDVNVEFTQDEWQQMGPAQRNLYRDVMLENYSNLVSVGYCIFKPKVIFRLEQGEEPWSSEEEFSSQRRPKNYRDGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59717 - protein, 1719 aa, synthetic construct
MAPKKKRKVSRLQELLTFKDVSVEFSVDEWACLDPAQQTLYRDVMLENYRHLVFLGLTPSKPHLITCLEQSKEPWKVKAYQTVVKHPAVSNHGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59718 - protein, 1719 aa, synthetic construct
MAPKKKRKVSREMGLLTFRDIAIEFSLEEWQCLDCAQRNLYRDVMLENYRNLVSLGIAVSKPDLITCLEQNKESQNIKRNKMVAKHPVMHSHGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59719 - protein, 1719 aa, synthetic construct
MAPKKKRKVSRAQVLVTFQDVAVDFTQEEWRLLDPGQKELYKEVMLENVQNVLSLGLPVPREDWISHFDQGRAPWMLEGEGPSNSCLGRERRGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59720 - protein, 1719 aa, synthetic construct
MAPKKKRKVSRRVVFEDVAVYFSQEEWGLLDEAQRHLYHAVMTENFALVTSLGCWHGAQYEEAPSEQSVSVGMSEVGTPKPDPSTKKAQPYEGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59721 - protein, 1719 aa, synthetic construct
MAPKKKRKVSRIQGQVNFEDVFVYFSQEEWVLLDEAQRLLYRDVMLENFALMASLGHTSFTSHTVASLVMGPDWVDVTPAVATGTLSGSGPGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59722 - protein, 1719 aa, synthetic construct
MAPKKKRKVSRVFQGSLSFEDVTVDFSREEWRLLDLAQKSLYRDVMLENYFNLISVGCQVPKQEVLFSLEQEEPRMLDGEISSHNCLGGDIGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59723 - protein, 1719 aa, synthetic construct
MAPKKKRKVSRFQASVTFKDVAVDFTWEEWRLLDPPQKELFWEVMLENYRNLVCLGLADSNKDVMMSKLESGEPHWIPTGGVLRSCWPGWESGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59724 - protein, 1719 aa, synthetic construct
MAPKKKRKVSRKPGAVSFADVAVYFSPEEWGCLRPAQRALYRDVMRETYGHLGALGFPGPKPALISWMEQESEAWSSAAQDPEKGENLGGARGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59725 - protein, 1719 aa, synthetic construct
MAPKKKRKVSRVQEPVTFKDVAVDFTQEEWGQLDLVQRTLYRDVMLETYGHLLSVGNQIAKPEVISLLEQGEEPWSMEQACPQRTCPEWMRNGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59726 - protein, 1719 aa, synthetic construct
MAPKKKRKVSRVQSHVVFEDVAIYFSQEEWGLLDEAQRFLYHAVMLENFALLSSLGCWHGAQDEQALSEQGVSVGGSQVRTPKPAPSIQKSQGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59727 - protein, 1719 aa, synthetic construct
MAPKKKRKVSRTQLTVEDVDIKFTPEEWECLDPAQRALYWDVMEETYRNLLSVDVSHIHMTKKLQAKANSGKGEILQTVMFGRAETHEIKDFGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59728 - protein, 1719 aa, synthetic construct
MAPKKKRKVSRAEGHVTFEDVAVYFSWEEWGLLDEAQRLLYRDVMLENLALMASLGLASSRTHEITQLEWWREPFLPPCGVVTAAMPRGWRRGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59729 - protein, 1719 aa, synthetic construct
MAPKKKRKVSRLVSFEDVAMDFSREEWQQLDPAQRCLYQDVMLEIYSHLLSVEGALGLKTSQQKIFEKASFHNGKESEVTRGGMWCSISEDLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59730 - protein, 1719 aa, synthetic construct
MAPKKKRKVSREQESVSFKDVTIDFSREEWQQLDFAQKSLYRDVMLENYFNLISVGCQVPKPEVIFNLEQVENSCMLHRKISRQSCLDGDIGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59731 - protein, 1719 aa, synthetic construct
MAPKKKRKVSRPKVPVTFDDVAVYFSESEWGRLDKWQKELYKHVMRGNYEMLVSLDYAISKPDILTRMERGEEPCPDGPWGPEEGKEREAARGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59732 - protein, 1719 aa, synthetic construct
MAPKKKRKVSRSQGLVAFEDVAVYFSLEEWERLDADQRELYQEVMQENYGILVSLGYPIPKPDLIFRLEQGEEPWVPDSPRPEEGDIVTGVYGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59733 - protein, 1719 aa, synthetic construct
MAPKKKRKVSRMEGLVMFRDVAVDFSQEEWACLDPAQRGLYRDVMLENYHHLVSLGLSLSKPDVISLLEQGKEPWMVSRNMAGGWCPDRLKNGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59734 - protein, 1719 aa, synthetic construct
MAPKKKRKVSRVRMPVTFEDVAVTFTQEEWGQLDPAQRTLYQEVMLETCGLLVSLGCPLPKPELFYPLDHSPELQTLKRGLSPNSCPGDSTKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59735 - protein, 1719 aa, synthetic construct
MAPKKKRKVSRGPLTFRDVAIEFSQEEWKSLDPVQKALYWDVMLENYRNLVFLGILPKCMTKELPPIGNSNTGEKCQTVMLERHECYDVENFGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59736 - protein, 1718 aa, synthetic construct
MAPKKKRKVSRMAPSQGRLTFEDVAIEFSQEEWECLDPAQRALYGEVMLETYRNLVSLGLTSKDSCSLRKKPRRRRRGQKRTREWPLLRYHGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59737 - protein, 1719 aa, synthetic construct
MAPKKKRKVSRSQGLLTFKDVAIEFSPEEWEYLDPPQRMLYRTVMLENHRNLVFLGLAVSKPDLIMCLEQRREPWNVKSHSKLAKSPAVTSHGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59738 - protein, 1719 aa, synthetic construct
MAPKKKRKVSRMAFEDVAVYFSQEEWGLLDTAQRALYRRVMLDNFALVASLGLSTTRPRVVIQLERGEEPWVPSGTDMTMSRNAHRRRNPGSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59739 - protein, 1719 aa, synthetic construct
MAPKKKRKVSRFQGSLSFEDVTVGFSQEEWQHLDPAQRTLYRDVMLENYSHLVAVGCCVPKPDVIFRLEQGQQPWLVEEESLDQIWPEVCRVGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59740 - protein, 1719 aa, synthetic construct
MAPKKKRKVSRSLALVTFKDVLVNFTREEWKLLDAAQQVMYRDVMLENYRNLVSLGHRLPKPDVILQLEKGEEPWLVERGTHQDAHPDWDTAGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59741 - protein, 1718 aa, synthetic construct
MAPKKKRKVSRLQRLLTFGDVAIEFSQEEWRCLSHTQRELYRDVMLENYRHLLFLGLIVSKPDLVSLLEQRKEPWDVKRKKTVVFDPGRWEGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59742 - protein, 1719 aa, synthetic construct
MAPKKKRKVSRALRSVMFSDISIDFSPEEWDCLDLEQKDLYRDVMLENYSNLVSLGCFISKPDVISLLEQGKEPWKVVRKRRGQCPDLQTKYGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59743 - protein, 1719 aa, synthetic construct
MAPKKKRKVSRSVTFRDVIVDFTQEEWQQLKPAQKDLYRDVMMEVYWNLVSLDVETRPDAKESDPQEDDWEDRPSVVVIAEGPTRNGARSYTGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59744 - protein, 1719 aa, synthetic construct
MAPKKKRKVSRDRVKFTFSDVAVYFSEEEWQLLEEQQKELYQNVMKENYTTLMSLGYTTVKPDVISKIEQGKQPLVSSPSGSKGRRAIGRPSGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59745 - protein, 1719 aa, synthetic construct
MAPKKKRKVSRMQVKFEDVAVSFSQEEWEYLDEGQKELYREVMKENYETLLSLGLKCLQKIHESDRPFTYPACGKSFNHQSNLRKHKRNHTGGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59746 - protein, 1719 aa, synthetic construct
MAPKKKRKVSRCSKEPLCLQEPVSFADVAVYFSREEWALLDPAQRALYWDVMLETYECIASLGGEDPWIPDVHGLKDMAGDTCPGDGIADLKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59747 - protein, 1719 aa, synthetic construct
MAPKKKRKVSRVTFEEVAVYFSEEEWALLDPGQRALYRDVMQENYETVISLGKDFCPLSPEQVALCGMLCGRSEGHVSQSPEQRETCKRQHKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59748 - protein, 1719 aa, synthetic construct
MAPKKKRKVSRLLTFEDVAVHFSEEEWQLLDPNQKTLYNEVMWDICEAASFVGLKFKNDTGNAEPSSVSALEIQAAERQGSKTRKNVARKRKGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59749 - protein, 1719 aa, synthetic construct
MAPKKKRKVSRQPQGTMTFKDVEVTFSQDEWGLLDASQRNLYRDVMLENYGNMASVVGPFTKPALISWLEAREPWGLNVQGVQFKGNPGAAPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59750 - protein, 1719 aa, synthetic construct
MAPKKKRKVSRLLTFEDVAVSFSEEEWELLDPPQKTLYNDVMQENYETVISLGLKLKNDTGNDQPISISALEMQASGSKVLRKARMKVAQKTGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59751 - protein, 1719 aa, synthetic construct
MAPKKKRKVSRTQGSLTFKDVAIEFSQEEWKCLDPVQKALYRDVMLENYRNLGFLGLCLPDLDIISMLEQGKEPWTVVSQVKITRNPNCGECGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59752 - protein, 1719 aa, synthetic construct
MAPKKKRKVSRGEEPVNFEEVAVYFSREEWALLDPAQRALYRDVMLETYECVASLAPLPAPKPMVISLLEEGEEPWIPDVGSPEAVAGDVSPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59753 - protein, 1719 aa, synthetic construct
MAPKKKRKVSRSQESVTFQDVTVDFTQEEWCMLDCSQKKLYREVMLENVQNLLSVGLPVPRENLLSSCQQGDSPWLLEQKGTRIFRADAEICGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59754 - protein, 1722 aa, synthetic construct
MAPKKKRKVSRVTYNDVHVDITQEEWALMDPSQRNLYKDVMVETYMNLTAIGYNWENLEVEEPCQNPLKHGRHERPHTGEKPYEYNQCGKAFAQPGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59755 - protein, 1728 aa, synthetic construct
MAPKKKRKVSRVAFRDVIVDFTQEEWQQLKPAQKDLYRDVMMEIYWNLVSLDLETEGDMNEPDPEKDSWEDRTSIVVVEGLMRNGAQGYACEKAGIQGCRVGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59756 - protein, 1725 aa, synthetic construct
MAPKKKRKVSRVTFEDVAVNFTLEEWALLDPSQKKLYRDVMRETLRNLASVGEKWEDHDIEDQYKNQGRKLRSHVLERLCESKEGSQCGENFSLIPNLGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59757 - protein, 1731 aa, synthetic construct
MAPKKKRKVSRFREVSVYFSEEEWSWLDPDQKALYWEVMLENHRNMASLGDDGQENKDSYELLQGITARDTMETSAIEMEVERYKEKQSDDWNQESSSCTDDSVGGSGGGSAMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59758 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMMFQDSVAFEDVAVTFTQEEWALLDPSQKNLYRDVMQETFRNLASIGKKWKPQNIYVEYENLRRNLRIVGERLFESKEGHQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59759 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDPSAEGLSEEVPVVFEELPVVFEDVAVYFTREEWGMLDKRQKELYRDVMRMNYELLASLGPAAAKPDLISKLERRAAPWIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59760 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMIQAQESITLEDVAVDFTWEEWQLLGAAQKDLYRDVMLENYSNLVAVGYQASKPDALFKLEQGEQPWTTEDGIHSGACSDMGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59761 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDSVAFEDVAVNFTQEEWALLDPSQKNLYREVMQETVRNLASIGKKWNNQYIEDEHQNPRKNLRRLIGERLSESKESHQHGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59762 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMPGPPGSLEMDPLTFRDVAIEFSLEEWQCLDTAQQNLYRNVMLENYKNLAFLGIAVSKPDLITRLEKEKEPWKMKRHRMVDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59763 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEAVTFKDVAVFFTEEELGLLDLAQRKLYRDVMLENFRNLLSVGHQPFHQDVFHFLREEKFWMMETATQREGNSGENASVHPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59764 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRALTPVSMTAEAKCTGFTQGSVTFEDVAIYFSQEEWGLLDEAQRLLYRDVMLENFALLTSLVCWHGMEDEETPEQSVSVNGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59765 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDPSAERLMEEVPVVFEELPVVFEDVAVYFTREEWGMLDKRQKELYRDVMRMNYELLASLGPAAAKPDLISKLERRAAPWIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59766 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLAPEDHGSSYEGSVSFRDVAIDFSREEWRHLDLSQRNLYRDVMLETYSHLLSVGYQVPEAEVVMLEQGNEPWSLQGERPHQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59767 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAAAALRLPAQGTVTFEDVAVKFSQEEWSLLSEAQRCLYHDVMLENLALISSLGCWYGANDETPSKQTLSIQQQSPLRSHWGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59768 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSVTFEDVAVNFSLEEWNLLNEAQRCLYRDVMLETLTLISSLGAPPHTLFPARACGPEAPPSRHCPRPSLCLSLSPLHPTGVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59769 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMELREAFEDVAVYFTRKEWELLEDEDKELYRDLMLRNYQALVSLGYQGPTPGLICRIKQREVELWVCDDEHHGESSVSENLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59770 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQGSVSFEDVAVYFTEEEWALLDSSQRALHREVMLENSRNLAAVGYGQEHKNYQEPSLALFQSEERMLGIQRVLQKTRRSCLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59771 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLVKFEEVAVVFSEDEWNLLSDQQRGLYMEVMKENYEHLIYLGYEVPVILSLLQDGGGISSDAGSQSKSQQVAVAEGSNVNSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59772 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQVPVTFEDVAVYFCEGEWETLAEWQKELYRETMKENYETLTSLGFSSKKPSLISKIEREEDPCVRDKQDSRDRRRLRSCWGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59773 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDVVTFKDVAIYFSPEEWVRLSAGQRELYQEVMLDNYELVTSLDRESKLLYKMDPEEESCEGVPYSSADSGAPDSSSTSACGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59774 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQCLLTFGDVSVDFSQEEWECLDSAQRALYIDVMLENYSNLVSVENYSTCDTVHQHVNTGKESCQRNNLGEMLRNPSHDALGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59775 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGNEMVTFKDVAVVFSGEELELLDSAQWKLYQDVMLENFRNLLSVGGRIQTELETFPEAGPHEELSWQQIWEQIASDSTFSQDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59776 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGARVAVMFSDVSIAFSQEEWEYLDLAQRDLYKDVMMENYRNVASLAGCFISKPDVISLLEQGKEPWKVVRKRRRNPDLETKDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59777 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQSLLSFGDVAVDFSQEEWEYLDYDQRTLYMDVMLENYSNLVFVENHRIYGKYEKDLDQGTKHIAHEDVIIQEKSYKCNELGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59778 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGIQNTVTYDDVHIDFTWEEWTLLDPSQRNLYKDVMVETYTNLTAVGYSWEDHNMEEHCQSSQRQRRYKRSNTGEKPCEYTQCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59779 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNAVTYEDVHVNFTQEEWALLDPSQKKLYKDVMLETYRNLNAIGFNWDSKIFKNIVQVLEDTEGMKEVRVQRKRLNILNVIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59780 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAVTMEDVTVTFTNEEWALLNPAQKRLYGDVMWETFRTISAIGRTWDSQQMEEEYKNYLRNLSNEEVAKCCRYTTFNQHENIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59781 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGALVTFEDVAVRFTQEEWALLDPSQKILYRDVMRETYRNLTSVGINWECWDLEACFRSLGRNLRVQVVKRKCELTNSGPCAEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59782 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSNKLVSFDDVAVEFSWEEWQELDISQRTLYRDVMLETYSMLVSLGHTGPKPQLIVKLEQDEESYMREASDKNFSDVQKMKHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59783 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKPGAVSFADVAVYFSPEEWGCLRPAQRALYRDVMRETYGHLGALGFPGPKPALISWMEQESEAWSPAAQDPEKGERLGGARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59784 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQEPLKFRDVAVEFSLEEWQCLDTIQQNLYRNVMLENYRNLVFLGIAVSKPDLITCLEQEKEPWTRKRHRMVAKPVTCSHFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59785 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGRLRFQDVAIDFTLEEWECLDLGQRELYRDVMLENYGNLASLGLIVCKPDLVTFLEKMRDPQDVRGIETTAIHPDLASFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59786 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQSPLTFGDVAVEFSGEEWAWLDSAQRSLHRSVMLENYRNLASLGLCLSKPEMISSLEQRKEPWAVKRKSTRGMRPDSQTLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59787 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRAEEAVTFKDVAVVFTEEELQLLDLAQRKLYRDVMLENFRNLLSVGHQPFHGDTFHFLREEKFWVMETTSQREGNSGGKIQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59788 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQAPVTFGDLAIYFSQEEWECLSPIQKDLYEDVMLENYQNLVSLGLSFRRPNVITLLEKGKAPWMVEPVKRRRGLDLGSKCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59789 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGPVSFEDVAVDFTQEEWQQLDPAQRTLYRDVMLENYSHLVSVGYPVSKPGVISKLEQGEEPWIMKRDISNWIYPDRETRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59790 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVAFEDVAVYFTTKEWAIMVPAERALYRDVMLENYEAVAFVVPPTSKPALVSHLEQGKESCFIRPQGVLSRSDWRAGLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59791 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQGSISFKDVTVGFTQEEWQHLDPSQRALYRDVMLENYSNLVSVGYCVHKPEVISRLEQGEEPWRLEEEFPSQSFPVWTADGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59792 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQESVTFKDVAVDFTWEEWGYLDTSQKELYQEVMLENYRNLVSLGFVVAKPDVISQLEQGEAPWRPEGRFPRSRHPDSDTRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59793 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGCYQDSVTFDDVAVDFTQEEWTLLDSTQRSLYSDVMLENYKNLATVGGQIIKPSLISWLEQEESRTVQGGVLRGRKTQWRGTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59794 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQESVTFKDIAVDFTQEEWALLDASQRKLYRDVMLENIGHLVSVGYRVCKSDVISQLQQGVELWREGRGFPQGVIPDRKSSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59795 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMGQLTFNDVTIEFSLEEWQCLDKPQQNLYREVMLENYRNLVFLGIAVSKPDLITCLKQGKEPWNIRRHEMVTKPPAMCSHFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59796 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVWGPLSFMDVFVDFTWEEWQLLDPAQKCLYRSVMLENYSNLVSLGYQHTKPDIIFKLEQGEELCMVQAPIPNQCCPNKVWKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59797 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSKAPITFGDLAIYFSQEEWEWLSPIQKDLYEDVMLENYRNLVSLGLSFRRPNVITLLEKGKAPWMVEPARRRRGPDSGSKVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59798 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQASVVFEDVAVNFTPEEWALLNRGQRKLYRDVMLETCRNLSAVGKDGSIPSLVFSEKQKFHSSGDLTRMQEGLLRSPLVEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59799 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQEQVSFKDVCVDFTREEWYLLDPAQKILYRDVILENYSHLVSVGNCITKPEVIFKIEQGEEPWILEERFPKQCCSERNWKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59800 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMVSFEDVAVLLSQEEWDCLIPAQRGLYRDVMLETYGNLVSLGLQASKPDVISRLEQGDEPWTTHTLRMQGSWSWRHKREGCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59801 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQASVSFKDVNVEFTQDEWQQMGPAQRNLYRDVMLENYSNLVSVGYCIFKPKVIFRLEQGEEPWSSEEEFSSQRRPKNYRDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59802 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLQELLTFKDVSVEFSVDEWACLDPAQQTLYRDVMLENYRHLVFLGLTPSKPHLITCLEQSKEPWKVKAYQTVVKHPAVSNHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59803 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEMGLLTFRDIAIEFSLEEWQCLDCAQRNLYRDVMLENYRNLVSLGIAVSKPDLITCLEQNKESQNIKRNKMVAKHPVMHSHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59804 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAQVLVTFQDVAVDFTQEEWRLLDPGQKELYKEVMLENVQNVLSLGLPVPREDWISHFDQGRAPWMLEGEGPSNSCLGRERRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59805 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRVVFEDVAVYFSQEEWGLLDEAQRHLYHAVMTENFALVTSLGCWHGAQYEEAPSEQSVSVGMSEVGTPKPDPSTKKAQPYEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59806 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGIQGQVNFEDVFVYFSQEEWVLLDEAQRLLYRDVMLENFALMASLGHTSFTSHTVASLVMGPDWVDVTPAVATGTLSGSGPGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59807 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVFQGSLSFEDVTVDFSREEWRLLDLAQKSLYRDVMLENYFNLISVGCQVPKQEVLFSLEQEEPRMLDGEISSHNCLGGDIGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59808 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQASVTFKDVAVDFTWEEWRLLDPPQKELFWEVMLENYRNLVCLGLADSNKDVMMSKLESGEPHWIPTGGVLRSCWPGWESGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59809 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKPGAVSFADVAVYFSPEEWGCLRPAQRALYRDVMRETYGHLGALGFPGPKPALISWMEQESEAWSSAAQDPEKGENLGGARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59810 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQEPVTFKDVAVDFTQEEWGQLDLVQRTLYRDVMLETYGHLLSVGNQIAKPEVISLLEQGEEPWSMEQACPQRTCPEWMRNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59811 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQSHVVFEDVAIYFSQEEWGLLDEAQRFLYHAVMLENFALLSSLGCWHGAQDEQALSEQGVSVGGSQVRTPKPAPSIQKSQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59812 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQLTVEDVDIKFTPEEWECLDPAQRALYWDVMEETYRNLLSVDVSHIHMTKKLQAKANSGKGEILQTVMFGRAETHEIKDFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59813 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAEGHVTFEDVAVYFSWEEWGLLDEAQRLLYRDVMLENLALMASLGLASSRTHEITQLEWWREPFLPPCGVVTAAMPRGWRRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59814 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLVSFEDVAMDFSREEWQQLDPAQRCLYQDVMLEIYSHLLSVEGALGLKTSQQKIFEKASFHNGKESEVTRGGMWCSISEDLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59815 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEQESVSFKDVTIDFSREEWQQLDFAQKSLYRDVMLENYFNLISVGCQVPKPEVIFNLEQVENSCMLHRKISRQSCLDGDIGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59816 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPKVPVTFDDVAVYFSESEWGRLDKWQKELYKHVMRGNYEMLVSLDYAISKPDILTRMERGEEPCPDGPWGPEEGKEREAARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59817 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGLVAFEDVAVYFSLEEWERLDADQRELYQEVMQENYGILVSLGYPIPKPDLIFRLEQGEEPWVPDSPRPEEGDIVTGVYGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59818 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMEGLVMFRDVAVDFSQEEWACLDPAQRGLYRDVMLENYHHLVSLGLSLSKPDVISLLEQGKEPWMVSRNMAGGWCPDRLKNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59819 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVRMPVTFEDVAVTFTQEEWGQLDPAQRTLYQEVMLETCGLLVSLGCPLPKPELFYPLDHSPELQTLKRGLSPNSCPGDSTKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59820 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGGPLTFRDVAIEFSQEEWKSLDPVQKALYWDVMLENYRNLVFLGILPKCMTKELPPIGNSNTGEKCQTVMLERHECYDVENFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59821 - protein, 1716 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAPSQGRLTFEDVAIEFSQEEWECLDPAQRALYGEVMLETYRNLVSLGLTSKDSCSLRKKPRRRRRGQKRTREWPLLRYHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59822 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGLLTFKDVAIEFSPEEWEYLDPPQRMLYRTVMLENHRNLVFLGLAVSKPDLIMCLEQRREPWNVKSHSKLAKSPAVTSHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59823 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAFEDVAVYFSQEEWGLLDTAQRALYRRVMLDNFALVASLGLSTTRPRVVIQLERGEEPWVPSGTDMTMSRNAHRRRNPGSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59824 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQGSLSFEDVTVGFSQEEWQHLDPAQRTLYRDVMLENYSHLVAVGCCVPKPDVIFRLEQGQQPWLVEEESLDQIWPEVCRVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59825 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSLALVTFKDVLVNFTREEWKLLDAAQQVMYRDVMLENYRNLVSLGHRLPKPDVILQLEKGEEPWLVERGTHQDAHPDWDTAGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59826 - protein, 1716 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLQRLLTFGDVAIEFSQEEWRCLSHTQRELYRDVMLENYRHLLFLGLIVSKPDLVSLLEQRKEPWDVKRKKTVVFDPGRWEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59827 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGALRSVMFSDISIDFSPEEWDCLDLEQKDLYRDVMLENYSNLVSLGCFISKPDVISLLEQGKEPWKVVRKRRGQCPDLQTKYGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59828 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSVTFRDVIVDFTQEEWQQLKPAQKDLYRDVMMEVYWNLVSLDVETRPDAKESDPQEDDWEDRPSVVVIAEGPTRNGARSYTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59829 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGDRVKFTFSDVAVYFSEEEWQLLEEQQKELYQNVMKENYTTLMSLGYTTVKPDVISKIEQGKQPLVSSPSGSKGRRAIGRPSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59830 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMQVKFEDVAVSFSQEEWEYLDEGQKELYREVMKENYETLLSLGLKCLQKIHESDRPFTYPACGKSFNHQSNLRKHKRNHTGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59831 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGCSKEPLCLQEPVSFADVAVYFSREEWALLDPAQRALYWDVMLETYECIASLGGEDPWIPDVHGLKDMAGDTCPGDGIADLKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59832 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTFEEVAVYFSEEEWALLDPGQRALYRDVMQENYETVISLGKDFCPLSPEQVALCGMLCGRSEGHVSQSPEQRETCKRQHKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59833 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLLTFEDVAVHFSEEEWQLLDPNQKTLYNEVMWDICEAASFVGLKFKNDTGNAEPSSVSALEIQAAERQGSKTRKNVARKRKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59834 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQPQGTMTFKDVEVTFSQDEWGLLDASQRNLYRDVMLENYGNMASVVGPFTKPALISWLEAREPWGLNVQGVQFKGNPGAAPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59835 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLLTFEDVAVSFSEEEWELLDPPQKTLYNDVMQENYETVISLGLKLKNDTGNDQPISISALEMQASGSKVLRKARMKVAQKTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59836 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQGSLTFKDVAIEFSQEEWKCLDPVQKALYRDVMLENYRNLGFLGLCLPDLDIISMLEQGKEPWTVVSQVKITRNPNCGECGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59837 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGGEEPVNFEEVAVYFSREEWALLDPAQRALYRDVMLETYECVASLAPLPAPKPMVISLLEEGEEPWIPDVGSPEAVAGDVSPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59838 - protein, 1717 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVTFQDVTVDFTQEEWCMLDCSQKKLYREVMLENVQNLLSVGLPVPRENLLSSCQQGDSPWLLEQKGTRIFRADAEICGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59839 - protein, 1720 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTYNDVHVDITQEEWALMDPSQRNLYKDVMVETYMNLTAIGYNWENLEVEEPCQNPLKHGRHERPHTGEKPYEYNQCGKAFAQPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59840 - protein, 1726 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVAFRDVIVDFTQEEWQQLKPAQKDLYRDVMMEIYWNLVSLDLETEGDMNEPDPEKDSWEDRTSIVVVEGLMRNGAQGYACEKAGIQGCRVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59841 - protein, 1723 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTFEDVAVNFTLEEWALLDPSQKKLYRDVMRETLRNLASVGEKWEDHDIEDQYKNQGRKLRSHVLERLCESKEGSQCGENFSLIPNLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59842 - protein, 1729 aa, synthetic construct
MAPKKKRKVSRMNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFREVSVYFSEEEWSWLDPDQKALYWEVMLENHRNMASLGDDGQENKDSYELLQGITARDTMETSAIEMEVERYKEKQSDDWNQESSSCTDDSVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59843 - protein, 1854 aa, synthetic construct
MAPKKKRKVSRMMFQDSVAFEDVAVTFTQEEWALLDPSQKNLYRDVMQETFRNLASIGKKWKPQNIYVEYENLRRNLRIVGERLFESKEGHQGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59844 - protein, 1854 aa, synthetic construct
MAPKKKRKVSRQDPSAEGLSEEVPVVFEELPVVFEDVAVYFTREEWGMLDKRQKELYRDVMRMNYELLASLGPAAAKPDLISKLERRAAPWIGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59845 - protein, 1854 aa, synthetic construct
MAPKKKRKVSRMIQAQESITLEDVAVDFTWEEWQLLGAAQKDLYRDVMLENYSNLVAVGYQASKPDALFKLEQGEQPWTTEDGIHSGACSDMGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59846 - protein, 1854 aa, synthetic construct
MAPKKKRKVSRMDSVAFEDVAVNFTQEEWALLDPSQKNLYREVMQETVRNLASIGKKWNNQYIEDEHQNPRKNLRRLIGERLSESKESHQHGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59847 - protein, 1854 aa, synthetic construct
MAPKKKRKVSRMPGPPGSLEMDPLTFRDVAIEFSLEEWQCLDTAQQNLYRNVMLENYKNLAFLGIAVSKPDLITRLEKEKEPWKMKRHRMVDGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59848 - protein, 1854 aa, synthetic construct
MAPKKKRKVSREAVTFKDVAVFFTEEELGLLDLAQRKLYRDVMLENFRNLLSVGHQPFHQDVFHFLREEKFWMMETATQREGNSGENASVHPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59849 - protein, 1854 aa, synthetic construct
MAPKKKRKVSRRALTPVSMTAEAKCTGFTQGSVTFEDVAIYFSQEEWGLLDEAQRLLYRDVMLENFALLTSLVCWHGMEDEETPEQSVSVNGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59850 - protein, 1854 aa, synthetic construct
MAPKKKRKVSRQDPSAERLMEEVPVVFEELPVVFEDVAVYFTREEWGMLDKRQKELYRDVMRMNYELLASLGPAAAKPDLISKLERRAAPWIGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59851 - protein, 1854 aa, synthetic construct
MAPKKKRKVSRLAPEDHGSSYEGSVSFRDVAIDFSREEWRHLDLSQRNLYRDVMLETYSHLLSVGYQVPEAEVVMLEQGNEPWSLQGERPHQGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59852 - protein, 1854 aa, synthetic construct
MAPKKKRKVSRMAAAALRLPAQGTVTFEDVAVKFSQEEWSLLSEAQRCLYHDVMLENLALISSLGCWYGANDETPSKQTLSIQQQSPLRSHWGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59853 - protein, 1854 aa, synthetic construct
MAPKKKRKVSRSVTFEDVAVNFSLEEWNLLNEAQRCLYRDVMLETLTLISSLGAPPHTLFPARACGPEAPPSRHCPRPSLCLSLSPLHPTGVGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59854 - protein, 1854 aa, synthetic construct
MAPKKKRKVSRMELREAFEDVAVYFTRKEWELLEDEDKELYRDLMLRNYQALVSLGYQGPTPGLICRIKQREVELWVCDDEHHGESSVSENLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59855 - protein, 1854 aa, synthetic construct
MAPKKKRKVSRQGSVSFEDVAVYFTEEEWALLDSSQRALHREVMLENSRNLAAVGYGQEHKNYQEPSLALFQSEERMLGIQRVLQKTRRSCLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59856 - protein, 1854 aa, synthetic construct
MAPKKKRKVSRLVKFEEVAVVFSEDEWNLLSDQQRGLYMEVMKENYEHLIYLGYEVPVILSLLQDGGGISSDAGSQSKSQQVAVAEGSNVNSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59857 - protein, 1854 aa, synthetic construct
MAPKKKRKVSRTQVPVTFEDVAVYFCEGEWETLAEWQKELYRETMKENYETLTSLGFSSKKPSLISKIEREEDPCVRDKQDSRDRRRLRSCWGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59858 - protein, 1854 aa, synthetic construct
MAPKKKRKVSRQDVVTFKDVAIYFSPEEWVRLSAGQRELYQEVMLDNYELVTSLDRESKLLYKMDPEEESCEGVPYSSADSGAPDSSSTSACGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59859 - protein, 1854 aa, synthetic construct
MAPKKKRKVSRSQCLLTFGDVSVDFSQEEWECLDSAQRALYIDVMLENYSNLVSVENYSTCDTVHQHVNTGKESCQRNNLGEMLRNPSHDALGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59860 - protein, 1854 aa, synthetic construct
MAPKKKRKVSRNEMVTFKDVAVVFSGEELELLDSAQWKLYQDVMLENFRNLLSVGGRIQTELETFPEAGPHEELSWQQIWEQIASDSTFSQDGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59861 - protein, 1854 aa, synthetic construct
MAPKKKRKVSRARVAVMFSDVSIAFSQEEWEYLDLAQRDLYKDVMMENYRNVASLAGCFISKPDVISLLEQGKEPWKVVRKRRRNPDLETKDGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59862 - protein, 1854 aa, synthetic construct
MAPKKKRKVSRPQSLLSFGDVAVDFSQEEWEYLDYDQRTLYMDVMLENYSNLVFVENHRIYGKYEKDLDQGTKHIAHEDVIIQEKSYKCNELGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59863 - protein, 1854 aa, synthetic construct
MAPKKKRKVSRIQNTVTYDDVHIDFTWEEWTLLDPSQRNLYKDVMVETYTNLTAVGYSWEDHNMEEHCQSSQRQRRYKRSNTGEKPCEYTQCGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59864 - protein, 1854 aa, synthetic construct
MAPKKKRKVSRMNAVTYEDVHVNFTQEEWALLDPSQKKLYKDVMLETYRNLNAIGFNWDSKIFKNIVQVLEDTEGMKEVRVQRKRLNILNVIGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59865 - protein, 1854 aa, synthetic construct
MAPKKKRKVSRAVTMEDVTVTFTNEEWALLNPAQKRLYGDVMWETFRTISAIGRTWDSQQMEEEYKNYLRNLSNEEVAKCCRYTTFNQHENIGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59866 - protein, 1854 aa, synthetic construct
MAPKKKRKVSRALVTFEDVAVRFTQEEWALLDPSQKILYRDVMRETYRNLTSVGINWECWDLEACFRSLGRNLRVQVVKRKCELTNSGPCAEGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59867 - protein, 1854 aa, synthetic construct
MAPKKKRKVSRSNKLVSFDDVAVEFSWEEWQELDISQRTLYRDVMLETYSMLVSLGHTGPKPQLIVKLEQDEESYMREASDKNFSDVQKMKHGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59868 - protein, 1854 aa, synthetic construct
MAPKKKRKVSRKPGAVSFADVAVYFSPEEWGCLRPAQRALYRDVMRETYGHLGALGFPGPKPALISWMEQESEAWSPAAQDPEKGERLGGARGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59869 - protein, 1854 aa, synthetic construct
MAPKKKRKVSRFQEPLKFRDVAVEFSLEEWQCLDTIQQNLYRNVMLENYRNLVFLGIAVSKPDLITCLEQEKEPWTRKRHRMVAKPVTCSHFGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59870 - protein, 1854 aa, synthetic construct
MAPKKKRKVSRSQGRLRFQDVAIDFTLEEWECLDLGQRELYRDVMLENYGNLASLGLIVCKPDLVTFLEKMRDPQDVRGIETTAIHPDLASFGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59871 - protein, 1854 aa, synthetic construct
MAPKKKRKVSRSQSPLTFGDVAVEFSGEEWAWLDSAQRSLHRSVMLENYRNLASLGLCLSKPEMISSLEQRKEPWAVKRKSTRGMRPDSQTLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59872 - protein, 1854 aa, synthetic construct
MAPKKKRKVSRRAEEAVTFKDVAVVFTEEELQLLDLAQRKLYRDVMLENFRNLLSVGHQPFHGDTFHFLREEKFWVMETTSQREGNSGGKIQGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59873 - protein, 1854 aa, synthetic construct
MAPKKKRKVSRFQAPVTFGDLAIYFSQEEWECLSPIQKDLYEDVMLENYQNLVSLGLSFRRPNVITLLEKGKAPWMVEPVKRRRGLDLGSKCGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59874 - protein, 1854 aa, synthetic construct
MAPKKKRKVSRSQGPVSFEDVAVDFTQEEWQQLDPAQRTLYRDVMLENYSHLVSVGYPVSKPGVISKLEQGEEPWIMKRDISNWIYPDRETRGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59875 - protein, 1854 aa, synthetic construct
MAPKKKRKVSRSQESVAFEDVAVYFTTKEWAIMVPAERALYRDVMLENYEAVAFVVPPTSKPALVSHLEQGKESCFIRPQGVLSRSDWRAGLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59876 - protein, 1854 aa, synthetic construct
MAPKKKRKVSRFQGSISFKDVTVGFTQEEWQHLDPSQRALYRDVMLENYSNLVSVGYCVHKPEVISRLEQGEEPWRLEEEFPSQSFPVWTADGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59877 - protein, 1854 aa, synthetic construct
MAPKKKRKVSRPQESVTFKDVAVDFTWEEWGYLDTSQKELYQEVMLENYRNLVSLGFVVAKPDVISQLEQGEAPWRPEGRFPRSRHPDSDTRGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59878 - protein, 1854 aa, synthetic construct
MAPKKKRKVSRCYQDSVTFDDVAVDFTQEEWTLLDSTQRSLYSDVMLENYKNLATVGGQIIKPSLISWLEQEESRTVQGGVLRGRKTQWRGTGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59879 - protein, 1854 aa, synthetic construct
MAPKKKRKVSRPQESVTFKDIAVDFTQEEWALLDASQRKLYRDVMLENIGHLVSVGYRVCKSDVISQLQQGVELWREGRGFPQGVIPDRKSSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59880 - protein, 1854 aa, synthetic construct
MAPKKKRKVSRMGQLTFNDVTIEFSLEEWQCLDKPQQNLYREVMLENYRNLVFLGIAVSKPDLITCLKQGKEPWNIRRHEMVTKPPAMCSHFGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59881 - protein, 1854 aa, synthetic construct
MAPKKKRKVSRVWGPLSFMDVFVDFTWEEWQLLDPAQKCLYRSVMLENYSNLVSLGYQHTKPDIIFKLEQGEELCMVQAPIPNQCCPNKVWKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59882 - protein, 1854 aa, synthetic construct
MAPKKKRKVSRSKAPITFGDLAIYFSQEEWEWLSPIQKDLYEDVMLENYRNLVSLGLSFRRPNVITLLEKGKAPWMVEPARRRRGPDSGSKVGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59883 - protein, 1854 aa, synthetic construct
MAPKKKRKVSRFQASVVFEDVAVNFTPEEWALLNRGQRKLYRDVMLETCRNLSAVGKDGSIPSLVFSEKQKFHSSGDLTRMQEGLLRSPLVEGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59884 - protein, 1854 aa, synthetic construct
MAPKKKRKVSRSQEQVSFKDVCVDFTREEWYLLDPAQKILYRDVILENYSHLVSVGNCITKPEVIFKIEQGEEPWILEERFPKQCCSERNWKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59885 - protein, 1854 aa, synthetic construct
MAPKKKRKVSRMVSFEDVAVLLSQEEWDCLIPAQRGLYRDVMLETYGNLVSLGLQASKPDVISRLEQGDEPWTTHTLRMQGSWSWRHKREGCGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59886 - protein, 1854 aa, synthetic construct
MAPKKKRKVSRSQASVSFKDVNVEFTQDEWQQMGPAQRNLYRDVMLENYSNLVSVGYCIFKPKVIFRLEQGEEPWSSEEEFSSQRRPKNYRDGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59887 - protein, 1854 aa, synthetic construct
MAPKKKRKVSRLQELLTFKDVSVEFSVDEWACLDPAQQTLYRDVMLENYRHLVFLGLTPSKPHLITCLEQSKEPWKVKAYQTVVKHPAVSNHGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59888 - protein, 1854 aa, synthetic construct
MAPKKKRKVSREMGLLTFRDIAIEFSLEEWQCLDCAQRNLYRDVMLENYRNLVSLGIAVSKPDLITCLEQNKESQNIKRNKMVAKHPVMHSHGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59889 - protein, 1854 aa, synthetic construct
MAPKKKRKVSRAQVLVTFQDVAVDFTQEEWRLLDPGQKELYKEVMLENVQNVLSLGLPVPREDWISHFDQGRAPWMLEGEGPSNSCLGRERRGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59890 - protein, 1854 aa, synthetic construct
MAPKKKRKVSRRVVFEDVAVYFSQEEWGLLDEAQRHLYHAVMTENFALVTSLGCWHGAQYEEAPSEQSVSVGMSEVGTPKPDPSTKKAQPYEGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59891 - protein, 1854 aa, synthetic construct
MAPKKKRKVSRIQGQVNFEDVFVYFSQEEWVLLDEAQRLLYRDVMLENFALMASLGHTSFTSHTVASLVMGPDWVDVTPAVATGTLSGSGPGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59892 - protein, 1854 aa, synthetic construct
MAPKKKRKVSRVFQGSLSFEDVTVDFSREEWRLLDLAQKSLYRDVMLENYFNLISVGCQVPKQEVLFSLEQEEPRMLDGEISSHNCLGGDIGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59893 - protein, 1854 aa, synthetic construct
MAPKKKRKVSRFQASVTFKDVAVDFTWEEWRLLDPPQKELFWEVMLENYRNLVCLGLADSNKDVMMSKLESGEPHWIPTGGVLRSCWPGWESGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59894 - protein, 1854 aa, synthetic construct
MAPKKKRKVSRKPGAVSFADVAVYFSPEEWGCLRPAQRALYRDVMRETYGHLGALGFPGPKPALISWMEQESEAWSSAAQDPEKGENLGGARGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59895 - protein, 1854 aa, synthetic construct
MAPKKKRKVSRVQEPVTFKDVAVDFTQEEWGQLDLVQRTLYRDVMLETYGHLLSVGNQIAKPEVISLLEQGEEPWSMEQACPQRTCPEWMRNGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59896 - protein, 1854 aa, synthetic construct
MAPKKKRKVSRVQSHVVFEDVAIYFSQEEWGLLDEAQRFLYHAVMLENFALLSSLGCWHGAQDEQALSEQGVSVGGSQVRTPKPAPSIQKSQGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59897 - protein, 1854 aa, synthetic construct
MAPKKKRKVSRTQLTVEDVDIKFTPEEWECLDPAQRALYWDVMEETYRNLLSVDVSHIHMTKKLQAKANSGKGEILQTVMFGRAETHEIKDFGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59898 - protein, 1854 aa, synthetic construct
MAPKKKRKVSRAEGHVTFEDVAVYFSWEEWGLLDEAQRLLYRDVMLENLALMASLGLASSRTHEITQLEWWREPFLPPCGVVTAAMPRGWRRGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59899 - protein, 1854 aa, synthetic construct
MAPKKKRKVSRLVSFEDVAMDFSREEWQQLDPAQRCLYQDVMLEIYSHLLSVEGALGLKTSQQKIFEKASFHNGKESEVTRGGMWCSISEDLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59900 - protein, 1854 aa, synthetic construct
MAPKKKRKVSREQESVSFKDVTIDFSREEWQQLDFAQKSLYRDVMLENYFNLISVGCQVPKPEVIFNLEQVENSCMLHRKISRQSCLDGDIGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59901 - protein, 1854 aa, synthetic construct
MAPKKKRKVSRPKVPVTFDDVAVYFSESEWGRLDKWQKELYKHVMRGNYEMLVSLDYAISKPDILTRMERGEEPCPDGPWGPEEGKEREAARGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59902 - protein, 1854 aa, synthetic construct
MAPKKKRKVSRSQGLVAFEDVAVYFSLEEWERLDADQRELYQEVMQENYGILVSLGYPIPKPDLIFRLEQGEEPWVPDSPRPEEGDIVTGVYGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59903 - protein, 1854 aa, synthetic construct
MAPKKKRKVSRMEGLVMFRDVAVDFSQEEWACLDPAQRGLYRDVMLENYHHLVSLGLSLSKPDVISLLEQGKEPWMVSRNMAGGWCPDRLKNGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59904 - protein, 1854 aa, synthetic construct
MAPKKKRKVSRVRMPVTFEDVAVTFTQEEWGQLDPAQRTLYQEVMLETCGLLVSLGCPLPKPELFYPLDHSPELQTLKRGLSPNSCPGDSTKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59905 - protein, 1854 aa, synthetic construct
MAPKKKRKVSRGPLTFRDVAIEFSQEEWKSLDPVQKALYWDVMLENYRNLVFLGILPKCMTKELPPIGNSNTGEKCQTVMLERHECYDVENFGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59906 - protein, 1853 aa, synthetic construct
MAPKKKRKVSRMAPSQGRLTFEDVAIEFSQEEWECLDPAQRALYGEVMLETYRNLVSLGLTSKDSCSLRKKPRRRRRGQKRTREWPLLRYHGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59907 - protein, 1854 aa, synthetic construct
MAPKKKRKVSRSQGLLTFKDVAIEFSPEEWEYLDPPQRMLYRTVMLENHRNLVFLGLAVSKPDLIMCLEQRREPWNVKSHSKLAKSPAVTSHGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59908 - protein, 1854 aa, synthetic construct
MAPKKKRKVSRMAFEDVAVYFSQEEWGLLDTAQRALYRRVMLDNFALVASLGLSTTRPRVVIQLERGEEPWVPSGTDMTMSRNAHRRRNPGSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59909 - protein, 1854 aa, synthetic construct
MAPKKKRKVSRFQGSLSFEDVTVGFSQEEWQHLDPAQRTLYRDVMLENYSHLVAVGCCVPKPDVIFRLEQGQQPWLVEEESLDQIWPEVCRVGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59910 - protein, 1854 aa, synthetic construct
MAPKKKRKVSRSLALVTFKDVLVNFTREEWKLLDAAQQVMYRDVMLENYRNLVSLGHRLPKPDVILQLEKGEEPWLVERGTHQDAHPDWDTAGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59911 - protein, 1853 aa, synthetic construct
MAPKKKRKVSRLQRLLTFGDVAIEFSQEEWRCLSHTQRELYRDVMLENYRHLLFLGLIVSKPDLVSLLEQRKEPWDVKRKKTVVFDPGRWEGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59912 - protein, 1854 aa, synthetic construct
MAPKKKRKVSRALRSVMFSDISIDFSPEEWDCLDLEQKDLYRDVMLENYSNLVSLGCFISKPDVISLLEQGKEPWKVVRKRRGQCPDLQTKYGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59913 - protein, 1854 aa, synthetic construct
MAPKKKRKVSRSVTFRDVIVDFTQEEWQQLKPAQKDLYRDVMMEVYWNLVSLDVETRPDAKESDPQEDDWEDRPSVVVIAEGPTRNGARSYTGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59914 - protein, 1854 aa, synthetic construct
MAPKKKRKVSRDRVKFTFSDVAVYFSEEEWQLLEEQQKELYQNVMKENYTTLMSLGYTTVKPDVISKIEQGKQPLVSSPSGSKGRRAIGRPSGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59915 - protein, 1854 aa, synthetic construct
MAPKKKRKVSRMQVKFEDVAVSFSQEEWEYLDEGQKELYREVMKENYETLLSLGLKCLQKIHESDRPFTYPACGKSFNHQSNLRKHKRNHTGGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59916 - protein, 1854 aa, synthetic construct
MAPKKKRKVSRCSKEPLCLQEPVSFADVAVYFSREEWALLDPAQRALYWDVMLETYECIASLGGEDPWIPDVHGLKDMAGDTCPGDGIADLKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59917 - protein, 1854 aa, synthetic construct
MAPKKKRKVSRVTFEEVAVYFSEEEWALLDPGQRALYRDVMQENYETVISLGKDFCPLSPEQVALCGMLCGRSEGHVSQSPEQRETCKRQHKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59918 - protein, 1854 aa, synthetic construct
MAPKKKRKVSRLLTFEDVAVHFSEEEWQLLDPNQKTLYNEVMWDICEAASFVGLKFKNDTGNAEPSSVSALEIQAAERQGSKTRKNVARKRKGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59919 - protein, 1854 aa, synthetic construct
MAPKKKRKVSRQPQGTMTFKDVEVTFSQDEWGLLDASQRNLYRDVMLENYGNMASVVGPFTKPALISWLEAREPWGLNVQGVQFKGNPGAAPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59920 - protein, 1854 aa, synthetic construct
MAPKKKRKVSRLLTFEDVAVSFSEEEWELLDPPQKTLYNDVMQENYETVISLGLKLKNDTGNDQPISISALEMQASGSKVLRKARMKVAQKTGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59921 - protein, 1854 aa, synthetic construct
MAPKKKRKVSRTQGSLTFKDVAIEFSQEEWKCLDPVQKALYRDVMLENYRNLGFLGLCLPDLDIISMLEQGKEPWTVVSQVKITRNPNCGECGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59922 - protein, 1854 aa, synthetic construct
MAPKKKRKVSRGEEPVNFEEVAVYFSREEWALLDPAQRALYRDVMLETYECVASLAPLPAPKPMVISLLEEGEEPWIPDVGSPEAVAGDVSPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59923 - protein, 1854 aa, synthetic construct
MAPKKKRKVSRSQESVTFQDVTVDFTQEEWCMLDCSQKKLYREVMLENVQNLLSVGLPVPRENLLSSCQQGDSPWLLEQKGTRIFRADAEICGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59924 - protein, 1857 aa, synthetic construct
MAPKKKRKVSRVTYNDVHVDITQEEWALMDPSQRNLYKDVMVETYMNLTAIGYNWENLEVEEPCQNPLKHGRHERPHTGEKPYEYNQCGKAFAQPGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59925 - protein, 1863 aa, synthetic construct
MAPKKKRKVSRVAFRDVIVDFTQEEWQQLKPAQKDLYRDVMMEIYWNLVSLDLETEGDMNEPDPEKDSWEDRTSIVVVEGLMRNGAQGYACEKAGIQGCRVGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59926 - protein, 1860 aa, synthetic construct
MAPKKKRKVSRVTFEDVAVNFTLEEWALLDPSQKKLYRDVMRETLRNLASVGEKWEDHDIEDQYKNQGRKLRSHVLERLCESKEGSQCGENFSLIPNLGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59927 - protein, 1866 aa, synthetic construct
MAPKKKRKVSRFREVSVYFSEEEWSWLDPDQKALYWEVMLENHRNMASLGDDGQENKDSYELLQGITARDTMETSAIEMEVERYKEKQSDDWNQESSSCTDDSVGGSGGGSAMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59928 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMMFQDSVAFEDVAVTFTQEEWALLDPSQKNLYRDVMQETFRNLASIGKKWKPQNIYVEYENLRRNLRIVGERLFESKEGHQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59929 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDPSAEGLSEEVPVVFEELPVVFEDVAVYFTREEWGMLDKRQKELYRDVMRMNYELLASLGPAAAKPDLISKLERRAAPWIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59930 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMIQAQESITLEDVAVDFTWEEWQLLGAAQKDLYRDVMLENYSNLVAVGYQASKPDALFKLEQGEQPWTTEDGIHSGACSDMGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59931 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMDSVAFEDVAVNFTQEEWALLDPSQKNLYREVMQETVRNLASIGKKWNNQYIEDEHQNPRKNLRRLIGERLSESKESHQHGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59932 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMPGPPGSLEMDPLTFRDVAIEFSLEEWQCLDTAQQNLYRNVMLENYKNLAFLGIAVSKPDLITRLEKEKEPWKMKRHRMVDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59933 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEAVTFKDVAVFFTEEELGLLDLAQRKLYRDVMLENFRNLLSVGHQPFHQDVFHFLREEKFWMMETATQREGNSGENASVHPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59934 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRALTPVSMTAEAKCTGFTQGSVTFEDVAIYFSQEEWGLLDEAQRLLYRDVMLENFALLTSLVCWHGMEDEETPEQSVSVNGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59935 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDPSAERLMEEVPVVFEELPVVFEDVAVYFTREEWGMLDKRQKELYRDVMRMNYELLASLGPAAAKPDLISKLERRAAPWIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59936 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLAPEDHGSSYEGSVSFRDVAIDFSREEWRHLDLSQRNLYRDVMLETYSHLLSVGYQVPEAEVVMLEQGNEPWSLQGERPHQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59937 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAAAALRLPAQGTVTFEDVAVKFSQEEWSLLSEAQRCLYHDVMLENLALISSLGCWYGANDETPSKQTLSIQQQSPLRSHWGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59938 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSVTFEDVAVNFSLEEWNLLNEAQRCLYRDVMLETLTLISSLGAPPHTLFPARACGPEAPPSRHCPRPSLCLSLSPLHPTGVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59939 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMELREAFEDVAVYFTRKEWELLEDEDKELYRDLMLRNYQALVSLGYQGPTPGLICRIKQREVELWVCDDEHHGESSVSENLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59940 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQGSVSFEDVAVYFTEEEWALLDSSQRALHREVMLENSRNLAAVGYGQEHKNYQEPSLALFQSEERMLGIQRVLQKTRRSCLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59941 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLVKFEEVAVVFSEDEWNLLSDQQRGLYMEVMKENYEHLIYLGYEVPVILSLLQDGGGISSDAGSQSKSQQVAVAEGSNVNSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59942 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQVPVTFEDVAVYFCEGEWETLAEWQKELYRETMKENYETLTSLGFSSKKPSLISKIEREEDPCVRDKQDSRDRRRLRSCWGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59943 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQDVVTFKDVAIYFSPEEWVRLSAGQRELYQEVMLDNYELVTSLDRESKLLYKMDPEEESCEGVPYSSADSGAPDSSSTSACGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59944 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQCLLTFGDVSVDFSQEEWECLDSAQRALYIDVMLENYSNLVSVENYSTCDTVHQHVNTGKESCQRNNLGEMLRNPSHDALGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59945 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGNEMVTFKDVAVVFSGEELELLDSAQWKLYQDVMLENFRNLLSVGGRIQTELETFPEAGPHEELSWQQIWEQIASDSTFSQDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59946 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGARVAVMFSDVSIAFSQEEWEYLDLAQRDLYKDVMMENYRNVASLAGCFISKPDVISLLEQGKEPWKVVRKRRRNPDLETKDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59947 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQSLLSFGDVAVDFSQEEWEYLDYDQRTLYMDVMLENYSNLVFVENHRIYGKYEKDLDQGTKHIAHEDVIIQEKSYKCNELGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59948 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGIQNTVTYDDVHIDFTWEEWTLLDPSQRNLYKDVMVETYTNLTAVGYSWEDHNMEEHCQSSQRQRRYKRSNTGEKPCEYTQCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59949 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMNAVTYEDVHVNFTQEEWALLDPSQKKLYKDVMLETYRNLNAIGFNWDSKIFKNIVQVLEDTEGMKEVRVQRKRLNILNVIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59950 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAVTMEDVTVTFTNEEWALLNPAQKRLYGDVMWETFRTISAIGRTWDSQQMEEEYKNYLRNLSNEEVAKCCRYTTFNQHENIGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59951 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGALVTFEDVAVRFTQEEWALLDPSQKILYRDVMRETYRNLTSVGINWECWDLEACFRSLGRNLRVQVVKRKCELTNSGPCAEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59952 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSNKLVSFDDVAVEFSWEEWQELDISQRTLYRDVMLETYSMLVSLGHTGPKPQLIVKLEQDEESYMREASDKNFSDVQKMKHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59953 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKPGAVSFADVAVYFSPEEWGCLRPAQRALYRDVMRETYGHLGALGFPGPKPALISWMEQESEAWSPAAQDPEKGERLGGARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59954 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQEPLKFRDVAVEFSLEEWQCLDTIQQNLYRNVMLENYRNLVFLGIAVSKPDLITCLEQEKEPWTRKRHRMVAKPVTCSHFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59955 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGRLRFQDVAIDFTLEEWECLDLGQRELYRDVMLENYGNLASLGLIVCKPDLVTFLEKMRDPQDVRGIETTAIHPDLASFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59956 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQSPLTFGDVAVEFSGEEWAWLDSAQRSLHRSVMLENYRNLASLGLCLSKPEMISSLEQRKEPWAVKRKSTRGMRPDSQTLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59957 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRAEEAVTFKDVAVVFTEEELQLLDLAQRKLYRDVMLENFRNLLSVGHQPFHGDTFHFLREEKFWVMETTSQREGNSGGKIQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59958 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQAPVTFGDLAIYFSQEEWECLSPIQKDLYEDVMLENYQNLVSLGLSFRRPNVITLLEKGKAPWMVEPVKRRRGLDLGSKCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59959 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGPVSFEDVAVDFTQEEWQQLDPAQRTLYRDVMLENYSHLVSVGYPVSKPGVISKLEQGEEPWIMKRDISNWIYPDRETRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59960 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVAFEDVAVYFTTKEWAIMVPAERALYRDVMLENYEAVAFVVPPTSKPALVSHLEQGKESCFIRPQGVLSRSDWRAGLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59961 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQGSISFKDVTVGFTQEEWQHLDPSQRALYRDVMLENYSNLVSVGYCVHKPEVISRLEQGEEPWRLEEEFPSQSFPVWTADGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59962 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQESVTFKDVAVDFTWEEWGYLDTSQKELYQEVMLENYRNLVSLGFVVAKPDVISQLEQGEAPWRPEGRFPRSRHPDSDTRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59963 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGCYQDSVTFDDVAVDFTQEEWTLLDSTQRSLYSDVMLENYKNLATVGGQIIKPSLISWLEQEESRTVQGGVLRGRKTQWRGTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59964 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPQESVTFKDIAVDFTQEEWALLDASQRKLYRDVMLENIGHLVSVGYRVCKSDVISQLQQGVELWREGRGFPQGVIPDRKSSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59965 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMGQLTFNDVTIEFSLEEWQCLDKPQQNLYREVMLENYRNLVFLGIAVSKPDLITCLKQGKEPWNIRRHEMVTKPPAMCSHFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59966 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVWGPLSFMDVFVDFTWEEWQLLDPAQKCLYRSVMLENYSNLVSLGYQHTKPDIIFKLEQGEELCMVQAPIPNQCCPNKVWKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59967 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSKAPITFGDLAIYFSQEEWEWLSPIQKDLYEDVMLENYRNLVSLGLSFRRPNVITLLEKGKAPWMVEPARRRRGPDSGSKVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59968 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQASVVFEDVAVNFTPEEWALLNRGQRKLYRDVMLETCRNLSAVGKDGSIPSLVFSEKQKFHSSGDLTRMQEGLLRSPLVEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59969 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQEQVSFKDVCVDFTREEWYLLDPAQKILYRDVILENYSHLVSVGNCITKPEVIFKIEQGEEPWILEERFPKQCCSERNWKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59970 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMVSFEDVAVLLSQEEWDCLIPAQRGLYRDVMLETYGNLVSLGLQASKPDVISRLEQGDEPWTTHTLRMQGSWSWRHKREGCGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59971 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQASVSFKDVNVEFTQDEWQQMGPAQRNLYRDVMLENYSNLVSVGYCIFKPKVIFRLEQGEEPWSSEEEFSSQRRPKNYRDGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59972 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLQELLTFKDVSVEFSVDEWACLDPAQQTLYRDVMLENYRHLVFLGLTPSKPHLITCLEQSKEPWKVKAYQTVVKHPAVSNHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59973 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEMGLLTFRDIAIEFSLEEWQCLDCAQRNLYRDVMLENYRNLVSLGIAVSKPDLITCLEQNKESQNIKRNKMVAKHPVMHSHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59974 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAQVLVTFQDVAVDFTQEEWRLLDPGQKELYKEVMLENVQNVLSLGLPVPREDWISHFDQGRAPWMLEGEGPSNSCLGRERRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59975 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGRVVFEDVAVYFSQEEWGLLDEAQRHLYHAVMTENFALVTSLGCWHGAQYEEAPSEQSVSVGMSEVGTPKPDPSTKKAQPYEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59976 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGIQGQVNFEDVFVYFSQEEWVLLDEAQRLLYRDVMLENFALMASLGHTSFTSHTVASLVMGPDWVDVTPAVATGTLSGSGPGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59977 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVFQGSLSFEDVTVDFSREEWRLLDLAQKSLYRDVMLENYFNLISVGCQVPKQEVLFSLEQEEPRMLDGEISSHNCLGGDIGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59978 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQASVTFKDVAVDFTWEEWRLLDPPQKELFWEVMLENYRNLVCLGLADSNKDVMMSKLESGEPHWIPTGGVLRSCWPGWESGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59979 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGKPGAVSFADVAVYFSPEEWGCLRPAQRALYRDVMRETYGHLGALGFPGPKPALISWMEQESEAWSSAAQDPEKGENLGGARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59980 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQEPVTFKDVAVDFTQEEWGQLDLVQRTLYRDVMLETYGHLLSVGNQIAKPEVISLLEQGEEPWSMEQACPQRTCPEWMRNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59981 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVQSHVVFEDVAIYFSQEEWGLLDEAQRFLYHAVMLENFALLSSLGCWHGAQDEQALSEQGVSVGGSQVRTPKPAPSIQKSQGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59982 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQLTVEDVDIKFTPEEWECLDPAQRALYWDVMEETYRNLLSVDVSHIHMTKKLQAKANSGKGEILQTVMFGRAETHEIKDFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59983 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGAEGHVTFEDVAVYFSWEEWGLLDEAQRLLYRDVMLENLALMASLGLASSRTHEITQLEWWREPFLPPCGVVTAAMPRGWRRGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59984 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLVSFEDVAMDFSREEWQQLDPAQRCLYQDVMLEIYSHLLSVEGALGLKTSQQKIFEKASFHNGKESEVTRGGMWCSISEDLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59985 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGEQESVSFKDVTIDFSREEWQQLDFAQKSLYRDVMLENYFNLISVGCQVPKPEVIFNLEQVENSCMLHRKISRQSCLDGDIGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59986 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGPKVPVTFDDVAVYFSESEWGRLDKWQKELYKHVMRGNYEMLVSLDYAISKPDILTRMERGEEPCPDGPWGPEEGKEREAARGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59987 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGLVAFEDVAVYFSLEEWERLDADQRELYQEVMQENYGILVSLGYPIPKPDLIFRLEQGEEPWVPDSPRPEEGDIVTGVYGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59988 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMEGLVMFRDVAVDFSQEEWACLDPAQRGLYRDVMLENYHHLVSLGLSLSKPDVISLLEQGKEPWMVSRNMAGGWCPDRLKNGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59989 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVRMPVTFEDVAVTFTQEEWGQLDPAQRTLYQEVMLETCGLLVSLGCPLPKPELFYPLDHSPELQTLKRGLSPNSCPGDSTKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59990 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGGPLTFRDVAIEFSQEEWKSLDPVQKALYWDVMLENYRNLVFLGILPKCMTKELPPIGNSNTGEKCQTVMLERHECYDVENFGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59991 - protein, 1851 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAPSQGRLTFEDVAIEFSQEEWECLDPAQRALYGEVMLETYRNLVSLGLTSKDSCSLRKKPRRRRRGQKRTREWPLLRYHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59992 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQGLLTFKDVAIEFSPEEWEYLDPPQRMLYRTVMLENHRNLVFLGLAVSKPDLIMCLEQRREPWNVKSHSKLAKSPAVTSHGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59993 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMAFEDVAVYFSQEEWGLLDTAQRALYRRVMLDNFALVASLGLSTTRPRVVIQLERGEEPWVPSGTDMTMSRNAHRRRNPGSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59994 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFQGSLSFEDVTVGFSQEEWQHLDPAQRTLYRDVMLENYSHLVAVGCCVPKPDVIFRLEQGQQPWLVEEESLDQIWPEVCRVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59995 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSLALVTFKDVLVNFTREEWKLLDAAQQVMYRDVMLENYRNLVSLGHRLPKPDVILQLEKGEEPWLVERGTHQDAHPDWDTAGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59996 - protein, 1851 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLQRLLTFGDVAIEFSQEEWRCLSHTQRELYRDVMLENYRHLLFLGLIVSKPDLVSLLEQRKEPWDVKRKKTVVFDPGRWEGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59997 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGALRSVMFSDISIDFSPEEWDCLDLEQKDLYRDVMLENYSNLVSLGCFISKPDVISLLEQGKEPWKVVRKRRGQCPDLQTKYGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59998 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSVTFRDVIVDFTQEEWQQLKPAQKDLYRDVMMEVYWNLVSLDVETRPDAKESDPQEDDWEDRPSVVVIAEGPTRNGARSYTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 59999 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGDRVKFTFSDVAVYFSEEEWQLLEEQQKELYQNVMKENYTTLMSLGYTTVKPDVISKIEQGKQPLVSSPSGSKGRRAIGRPSGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60000 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGMQVKFEDVAVSFSQEEWEYLDEGQKELYREVMKENYETLLSLGLKCLQKIHESDRPFTYPACGKSFNHQSNLRKHKRNHTGGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60001 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGCSKEPLCLQEPVSFADVAVYFSREEWALLDPAQRALYWDVMLETYECIASLGGEDPWIPDVHGLKDMAGDTCPGDGIADLKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60002 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTFEEVAVYFSEEEWALLDPGQRALYRDVMQENYETVISLGKDFCPLSPEQVALCGMLCGRSEGHVSQSPEQRETCKRQHKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60003 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLLTFEDVAVHFSEEEWQLLDPNQKTLYNEVMWDICEAASFVGLKFKNDTGNAEPSSVSALEIQAAERQGSKTRKNVARKRKGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60004 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGQPQGTMTFKDVEVTFSQDEWGLLDASQRNLYRDVMLENYGNMASVVGPFTKPALISWLEAREPWGLNVQGVQFKGNPGAAPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60005 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGLLTFEDVAVSFSEEEWELLDPPQKTLYNDVMQENYETVISLGLKLKNDTGNDQPISISALEMQASGSKVLRKARMKVAQKTGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60006 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGTQGSLTFKDVAIEFSQEEWKCLDPVQKALYRDVMLENYRNLGFLGLCLPDLDIISMLEQGKEPWTVVSQVKITRNPNCGECGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60007 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGGEEPVNFEEVAVYFSREEWALLDPAQRALYRDVMLETYECVASLAPLPAPKPMVISLLEEGEEPWIPDVGSPEAVAGDVSPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60008 - protein, 1852 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGSQESVTFQDVTVDFTQEEWCMLDCSQKKLYREVMLENVQNLLSVGLPVPRENLLSSCQQGDSPWLLEQKGTRIFRADAEICGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60009 - protein, 1855 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTYNDVHVDITQEEWALMDPSQRNLYKDVMVETYMNLTAIGYNWENLEVEEPCQNPLKHGRHERPHTGEKPYEYNQCGKAFAQPGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60010 - protein, 1861 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVAFRDVIVDFTQEEWQQLKPAQKDLYRDVMMEIYWNLVSLDLETEGDMNEPDPEKDSWEDRTSIVVVEGLMRNGAQGYACEKAGIQGCRVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60011 - protein, 1858 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGVTFEDVAVNFTLEEWALLDPSQKKLYRDVMRETLRNLASVGEKWEDHDIEDQYKNQGRKLRSHVLERLCESKEGSQCGENFSLIPNLGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60012 - protein, 1864 aa, synthetic construct
MAPKKKRKVSRMERLVYEVRQKCRNIEDICISCGSLNVTLEHPLFIGGMCQNCKNCFLECAYQYDDDGYQSYCTICCGGREVLMCGNNNCCRCFCVECVDLLVGPGAAQAAIKEDPWNCYMCGHKGTYGLLRRREDWPSRLQMFFANNHDQEFDPPKVYPPVPAEKRKPIRVLSLFDGIATGLLVLKDLGIQVDRYIASEVCEDSITVGMVRHQGKIMYVGDVRSVTQKHIQEWGPFDLVIGGSPCNDLSIVNPARKGLYEGTGRLFFEFYRLLHDARPKEGDDRPFFWLFENVVAMGVSDKRDISRFLESNPVMIDAKEVSAAHRARYFWGNLPGMNRPLASTVNDKLELQECLEHGRIAKFSKVRTITTRSNSIKQGKDQHFPVFMNEKEDILWCTEMERVFGFPVHYTDVSNMSRLARQRLLGRSWSVPVIRHLFAPLKEYFACVSSGNSNANSRGPSFSSGLVPLSLRGSHMGPMEIYKTVSAWKRQPVRVLSLFRNIDKVLKSLGFLESGSGSGGGTLKYVEDVTNVVRRDVEKWGPFDLVYGSTQPLGSSCDRCPGWYMFQFHRILQYALPRQESQRPFFWIFMDNLLLTEDDQETTTRFLQTEAVTLQDVRGRDYQNAMRVWSNIPGLKSKHAPLTPKEEEYLQAQVRSRSKLDAPKVDLLVKNCLLPLREYFKYFSQNSLPLGGSGGGFREVSVYFSEEEWSWLDPDQKALYWEVMLENHRNMASLGDDGQENKDSYELLQGITARDTMETSAIEMEVERYKEKQSDDWNQESSSCTDDSVGGPSSGAPPPSGGSPAGSPTSTEEGTSESATPESGPGTSTEPSEGSAPGSPAGSPTSTEEGTSTEPSEGSAPGTSTEPSEQEIKRINKIRRRLVKDSNTKKAGKTGPMKTLLVRVMTPDLRERLENLRKKPENIPQPISNTSRANLNKLLTDYTEMKKAILHVYWEEFQKDPVGLMSRVAQPASKKIDQNKLKPEMDEKGNLTTAGFACSQCGQPLFVYKLEQVSEKGKAYTNYFGRCNVAEHEKLILLAQLKPEKDSDEAVTYSLGKFGQRALDFYSIHVTKESTHPVKPLAQIAGNRYASGPVGKALSDACMGTIASFLSKYQDIIIEHQKVVKGNQKRLESLRELAGKENLEYPSVTLPPQPHTKEGVDAYNEVIARVRMWVNLNLWQKLKLSRDDAKPLLRLKGFPSFPLVERQANEVDWWDMVCNVKKLINEKKEDGKVFWQNLAGYKRQEALRPYLSSEEDRKKGKKFARYQLGDLLLHLEKKHGEDWGKVYDEAWERIDKKVEGLSKHIKLEEERRSEDAQSKAALTDWLRAKASFVIEGLKEADKDEFCRCELKLQKWYGDLRGKPFAIEAENSILDISGFSKQYNCAFIWQKDGVKKLNLYLIINYFKGGKLRFKKIKPEAFEANRFYTVINKKSGEIVPMEVNFNFDDPNLIILPLAFGKRQGREFIWNDLLSLETGSLKLANGRVIEKTLYNRRTRQDEPALFVALTFERREVLDSSNIKPMNLIGVARGENIPAVIALTDPEGCPLSRFKDSLGNPTHILRIGESYKEKQRTIQAKKEVEQRRAGGYSRKYASKAKNLADDMVRNTARDLLYYAVTQDAMLIFANLSRGFGRQGKRTFMAERQYTRMEDWLTAKLAYEGLSKTYLSKTLAQYTSKTCSNCGFTITSADYDRVLEKLKKTATGWMTTINGKELKVEGQITYYNRYKRQNVVKDLSVELDRLSEESVNNDISSWTKGRSGEALSLLKKRFSHRPVQEKFVCLNCGFETHAAEQAALNIARSWLFLRSQEYKKYQTNKTTGNTDKRAFVETWQSFYRKKLKEVWKPAVRSGGSGGGSTSPKKKRKV

SEQ ID NO: 60013 - RNA, 20 nt, synthetic construct
  source 1..20: mol_type = other RNA
cacgccaccccgagccccat

SEQ ID NO: 60014 - RNA, 20 nt, synthetic construct
  source 1..20: mol_type = other RNA
cagcctgcgcgtccacgtga
